US009988610B2

(12) United States Patent
Payne et al.

(10) Patent No.: US 9,988,610 B2
(45) Date of Patent: Jun. 5, 2018

(54) MODIFIED GLUCOSYLTRANSFERASES FOR PRODUCING BRANCHED ALPHA-GLUCAN POLYMERS

(71) Applicant: E I DU PONT DE NEMOURS AND COMPANY, Wilmington, DE (US)

(72) Inventors: Mark S Payne, Wilmington, DE (US); Yefim Brun, Wilmington, DE (US); Richard R Bott, Burlingame, CA (US)

(73) Assignee: E I DU PONT DE NEMOURS AND COMPANY, Wilmington, DE (US)

( * ) Notice: Subject to any disclaimer, the term of this patent is extended or adjusted under 35 U.S.C. 154(b) by 0 days. days.

(21) Appl. No.: 15/182,778

(22) Filed: Jun. 15, 2016

(65) Prior Publication Data

US 2017/0002336 A1    Jan. 5, 2017

Related U.S. Application Data

(60) Provisional application No. 62/180,788, filed on Jun. 17, 2015, provisional application No. 62/180,779, filed on Jun. 17, 2015.

(51) Int. Cl.
| | |
|---|---|
| C12N 9/10 | (2006.01) |
| C12N 9/24 | (2006.01) |
| C12P 19/04 | (2006.01) |
| C08B 37/00 | (2006.01) |
| C12P 19/18 | (2006.01) |
| C12Q 1/48 | (2006.01) |
| C12N 15/10 | (2006.01) |

(52) U.S. Cl.
CPC ........ *C12N 9/1051* (2013.01); *C08B 37/0009* (2013.01); *C12N 15/102* (2013.01); *C12P 19/04* (2013.01); *C12P 19/18* (2013.01); *C12Q 1/48* (2013.01); *C12Y 204/01027* (2013.01)

(58) Field of Classification Search
CPC .. C12N 9/1051; C12N 9/1048; C12N 15/102; C12Y 204/01027; C12P 19/04
USPC .................................. 435/200, 97; 536/23.2
See application file for complete search history.

(56) References Cited

U.S. PATENT DOCUMENTS

| 5,952,205 A | 9/1999 | Catani et al. |
|---|---|---|
| 6,207,149 B1 | 3/2001 | Fuglsang et al. |
| 6,242,225 B1 | 6/2001 | Catani et al. |
| 6,660,502 B2 | 12/2003 | Catani et al. |
| 7,000,000 B1 | 2/2006 | O'Brien |
| 8,269,064 B2 | 9/2012 | Kok-Jacon et al. |
| 8,871,474 B2 | 10/2014 | Payne et al. |
| 9,228,177 B2 | 1/2016 | Payne et al. |
| 9,260,701 B2 | 2/2016 | Payne et al. |
| 9,260,702 B2 | 2/2016 | Payne et al. |
| 9,284,539 B2 | 3/2016 | Payne et al. |
| 9,284,540 B2 | 3/2016 | Payne et al. |
| 9,296,996 B2 | 3/2016 | Payne et al. |
| 9,296,997 B2 | 3/2016 | Payne et al. |
| 2002/0155568 A1 | 10/2002 | Van Geel-Schutten et al. |
| 2006/0127328 A1 | 1/2006 | Monsan et al. |
| 2013/0244287 A1 | 9/2013 | O'Brien et al. |
| 2013/0244288 A1 | 9/2013 | O'Brien et al. |
| 2014/0087431 A1 | 3/2014 | Payne et al. |
| 2015/0232785 A1 | 8/2015 | Paullin et al. |
| 2015/0232819 A1 | 8/2015 | Paullin et al. |

FOREIGN PATENT DOCUMENTS

| WO | 2013036918 A2 | 3/2013 |
|---|---|---|
| WO | 2013036968 A1 | 3/2013 |
| WO | 2013096502 A1 | 6/2013 |
| WO | 2013096511 A1 | 6/2013 |

OTHER PUBLICATIONS

Devos et al., (Proteins: Structure, Function and Genetics, 2000, vol. 41: 98-107.*
Whisstock et al., (Quarterly Reviews of Biophysics 2003, vol. 36 (3): 307-340.*
Witkowski et al., (Biochemistry 38:11643-11650, 1999.*
Kisselev L., (Structure, 2002, vol. 10: 8-9.*
Abo et al., Peptide Sequences for Sucrose Splitting and Glucan Binding Within *Streptococcus sobrinus* Glucosyltransferase (Water-Insoluble Glucan Synthetase), Journal of Bacteriology, vol. 173, No. 3 (1991), pp. 989-996.
Cantarel et al., The Carbohydrate-Active Enzymes Database (CAZY): An Expert Resource for Glycogenomics, Nucleic Acids Research, vol. 37 (2009), Database Issue D233-238.
Chun et al., On the Intrinsic Viscosity of Anionic and Nonionic Rodlike Polysaccharide Solutions, Macromol. Chem. Phys., vol. 195 (1994), pp. 701-711.
Cote et al., Some Structural Features of an Insoluble-D-Glucan From a Mutant Strain of Leuconostoc Mesenteroides NRRL B-1355, Journal of Industrial Microbiology & Biotechnology, vol. 23 (1999), pp. 656-660.
Eifuku et al., Production and Partial Characterization of the Extra-Cellular Polysaccharides From Oral *Streptococcus salivarius*, Carbohydrate Research, vol. 194 (1999), pp. 247-260.
Funane et al., Changes in Linkage Pattern of Glucan Products Induced by Substitution of Lys Residues in the Dextransucrase, FEBS Letters, vol. 579 (2005), pp. 4739-4745.
Giffard et al., Molecular Characterization of a Cluster of at Least Two Glucosyltransferase Genes in *Streptococcus salivarius* ATCC 25975, Journal of General Microbiology, vol. 137 (1991), pp. 2577-2593.
Herget et al., Statistical Analysis of the Bacterial Carbohydrate Structure Data Base (BCSDB): Characteristics and Diversity of Bacterial Carbohydrates in Comparison With Mammalian Glycans, BMC Structural Biology, vol. 8, No. 35 (2008), pp. 1-20.
Jeanes et al., Characterization and Classification of Dextrans From Ninety-Six Strains of Bacteria, Contribution From the Starch and Dextrose Section, Northern Utilization Research Branch, vol. 76 (1954), pp. 5041-5052.

(Continued)

*Primary Examiner* — Robert B Mondesi
*Assistant Examiner* — Mohammad Y Meah

(57) ABSTRACT

Glucosyltransferase enzymes are disclosed herein that produce branched alpha-glucan polymer. Also disclosed, for example, are polynucleotides encoding these enzymes, as well as methods of producing branched alpha-glucan polymer.

4 Claims, 22 Drawing Sheets

(56) References Cited

OTHER PUBLICATIONS

Figure 1:
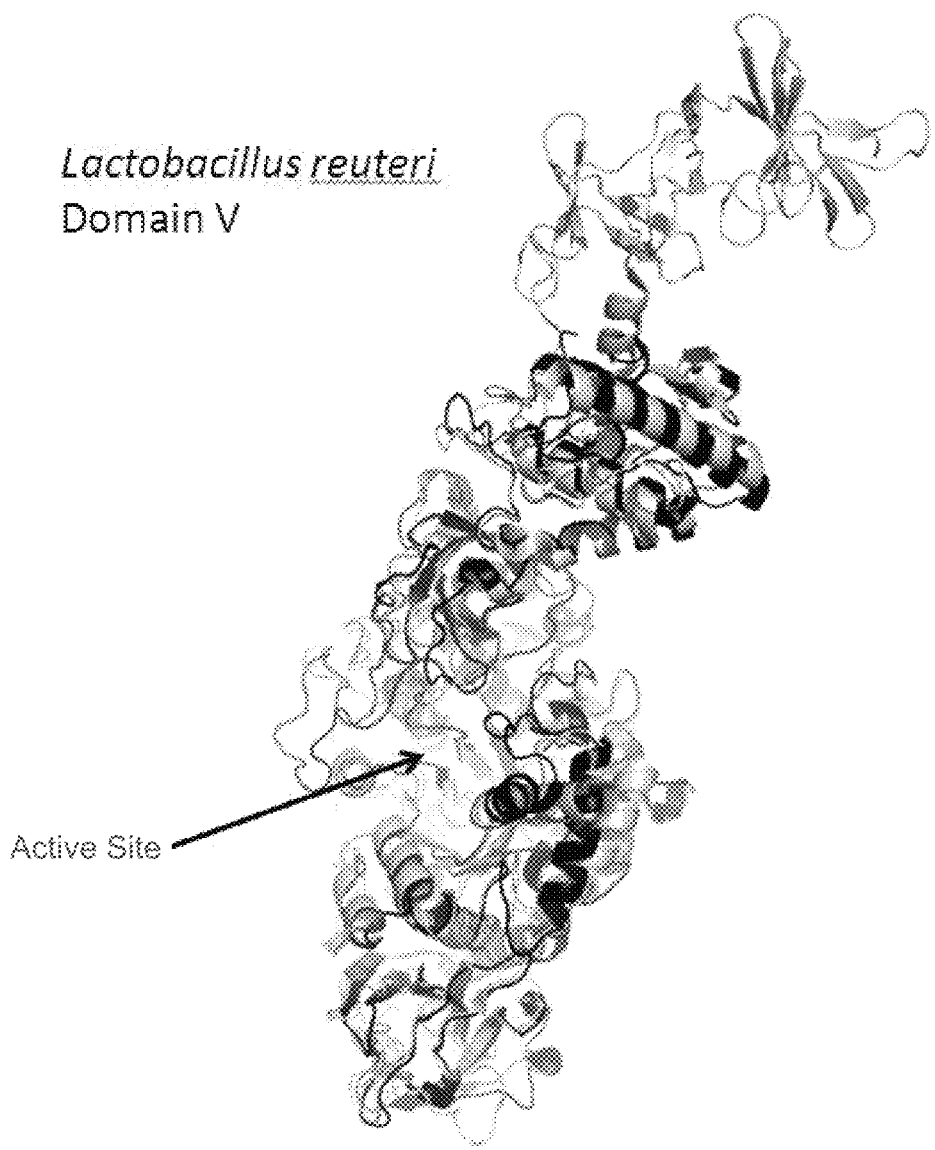

Kingston et al., Role of the C-Terminal YG Repeats of the Primer-Dependent Streptococcal Glucosyltransferase, GTFJ, in Binding to Dextran and Mutan, Microbiology, vol. 148 (2002), pp. 549-558.

Konishi et al., Structure and Enzymatic Properties of Genetically Truncated Forms of the Water-Insoluble Glucan-Synthesizing Glucosyltransferase From *Streptococcus sobrinus*, J. Biochem., vol. 126 (1999), pp. 287-295.

Leemhuis et al., Glucansucrases: Three-Dimensional Structures, Reactions, Mechanism, α-Glucan Analysis and Their Implications in Biotechnology and Food Applications, Journal of Biotechnology, vol. 163 (2013), pp. 250-272.

Monchois et al., Isolation of an Active Catalytic Core of *Streptococcus downei* MFE28 GTF-I Glucosyltransferase, Journal of Bacteriology, vol. 181, No. 7 (1999), pp. 2290-2292.

Monchois et al., Glucansucrases: Mechanism of Action and Structure-Function Relationships, FEMS Microbiology Reviews, vol. 23 (1999), pp. 131-151.

Rogers, Chapter 5: The Molecular Biology of Cariogenic Bacteria, From Molecular Biology, Horizon Scientific Press, Roy RB Russell (2008), pp. 120-122.

Simpson et al., Four Glucosyltransferases, GTFJ, GTFK, GTFL, and GTFM, From *Streptococcus salivarius* ATCC 25975, Microbiology, vol. 141 (1995), pp. 1451-1460.

Tsumuraya et al., Structure of the Water-Insoluble α-D-Glucan of *Streptococcus salivarius* HHT, Carbohydrate Research, vol. 74 (1979), pp. 217-225.

Weaver et al., Weighted Intrinsic Viscosity Relationships for Polysaccharide Mixtures in Dilute Aqueous Solutions, Journal of Applied Polymer Sciences, vol. 35 (1988), pp. 1631-1637.

Yakushiji et al., Inter-Serotype Comparison of Polysaccharides Produced by Extracellular Enzymes From *Streptococcus mutans*, Carbohydrate Research, vol. 127 (1984), pp. 253-266.

Yoshimi et al., Functional Analysis of the α-1,3-Glucan Synthase Genes AGSA and AGSB in Aspergillus Nidulans: AGSB is the Major α-1,3-Glucan Synthase in This Fungus, Plos One, vol. 8, No. 1 (2013),E54893, pp. 1-16.

PCT Application PCT/US2016/037661, Written Opinion dated Dec. 22, 2016.

\* cited by examiner

MODIFIED GLUCOSYLTRANSFERASES FOR PRODUCING BRANCHED ALPHA-GLUCAN POLYMERS

This application claims the benefit of U.S. Provisional Application Nos. 62/180,779 (filed Jun. 17, 2015) and 62/180,788 (filed Jun. 17, 2015), which are both incorporated herein by reference in their entirety.

FIELD OF INVENTION

The present disclosure is in the field of enzyme catalysis. For example, the disclosure pertains to the production of branched alpha-glucans using modified glucosyltransferase enzymes.

REFERENCE TO SEQUENCE LISTING SUBMITTED ELECTRONICALLY

The official copy of the sequence listing is submitted electronically via EFS-Web as an ASCII formatted sequence listing with a file named 20160615_CL6480 SequenceListing_ST25_ExtraLinesRemoved.txt created on Jun. 14, 2016, and having a size of 740 kilobytes and is filed concurrently with the specification. The sequence listing contained in this ASCII-formatted document is part of the specification and is herein incorporated by reference in its entirety.

BACKGROUND

Driven by a desire to find new structural polysaccharides using enzymatic syntheses or genetic engineering of microorganisms or plant hosts, researchers have discovered polysaccharides that are biodegradable and can be made economically from renewably sourced feedstocks. One such polysaccharide is poly alpha-1,3-glucan, a glucan polymer characterized by having alpha-1,3-glycosidic linkages. This polymer has been isolated by contacting an aqueous solution of sucrose with a glucosyltransferase (GTF) enzyme isolated from *Streptococcus salivarius* (Simpson et al., *Microbiology* 141:1451-1460, 1995).

U.S. Pat. No. 7,000,000 disclosed the preparation of a polysaccharide fiber using an *S. salivarius* gtfJ enzyme. At least 50% of the hexose units within the polymer of this fiber were linked via alpha-1,3-glycosidic linkages. *S. salivarius* gtfJ enzyme utilizes sucrose as a substrate in a polymerization reaction producing poly alpha-1,3-glucan and fructose as end-products (Simpson et al., 1995). The disclosed polymer formed a liquid crystalline solution when it was dissolved above a critical concentration in a solvent or in a mixture comprising a solvent. Continuous, strong, cottonlike fibers were obtained from this solution that could be spun and used in textile applications.

While some advances have been made in producing linear glucan polymers having a high percentage of alpha-1,3 glycosidic linkages suitable for use in spinning fibers, it is believed that less attention has been drawn to producing branched alpha-glucan polymers. To that end, disclosed herein are modified glucosyltransferases that can synthesize branched alpha-glucan.

SUMMARY OF INVENTION

In one embodiment, the disclosure concerns a glucosyltransferase enzyme comprising a catalytic domain that comprises an amino acid sequence that is at least 90% identical to amino acid positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97, wherein the catalytic domain lacks at least one motif selected from the group consisting of:
  (i) a motif comprising an amino acid sequence that is at least 90% identical to SEQ ID NO:78,
  (ii) a motif comprising an amino acid sequence that is at least 90% identical to SEQ ID NO:79, and
  (iii) a motif comprising an amino acid sequence that is at least 90% identical to SEQ ID NO:80;
wherein the glucosyltransferase enzyme produces a branched alpha-glucan polymer.

In another embodiment, the glucosyltransferase comprises an amino acid sequence that is at least 90% identical to SEQ ID NO:85, SEQ ID NO:87, SEQ ID NO:89, SEQ ID NO:91, SEQ ID NO:93, SEQ ID NO:95, or SEQ ID NO:97, and wherein the glucosyltransferase lacks at least one of motifs (i), (ii), or (iii).

Another embodiment concerns a polynucleotide comprising a nucleotide sequence encoding a glucosyltransferase enzyme as disclosed in the above embodiment, optionally wherein one or more regulatory sequences are operably linked to the nucleotide sequence, and preferably wherein the one or more regulatory sequences include a promoter sequence.

Another embodiment concerns a method of preparing a polynucleotide sequence encoding a glucosyltransferase enzyme that produces a branched alpha-glucan polymer. This method comprises:
(a) identifying a polynucleotide sequence encoding a parent glucosyltransferase enzyme that comprises a catalytic domain comprising:
  (1) an amino acid sequence that is at least 90% identical to amino acid positions 54-957 of SEQ ID NO:65, and
  (2) the following three motifs:
    (i) a motif comprising an amino acid sequence that is at least 90% identical to SEQ ID NO:78,
    (ii) a motif comprising an amino acid sequence that is at least 90% identical to SEQ ID NO:79, and
    (iii) a motif comprising an amino acid sequence that is at least 90% identical to SEQ ID NO:80;
  and
(b) modifying the polynucleotide sequence identified in step (a) to delete and/or mutate at least one of motifs (i), (ii), or (iii) encoded by the polynucleotide sequence, thereby providing a polynucleotide sequence encoding a glucosyltransferase enzyme that produces a branched alpha-glucan polymer.

In another embodiment, the position of the amino acid sequence that is at least 90% identical to SEQ ID NO:78 aligns with amino acid positions 231-243 of SEQ ID NO:65; the position of the amino acid sequence that is at least 90% identical to SEQ ID NO:79 aligns with amino acid positions 396-425 of SEQ ID NO:65; and/or the position of the amino acid sequence that is at least 90% identical to SEQ ID NO:80 aligns with amino acid positions 549-567 of SEQ ID NO:65.

In another embodiment, the motif (i) comprises SEQ ID NO:78, motif (ii) comprises SEQ ID NO:79, and motif (iii) comprises SEQ ID NO:80.

In another embodiment, the parent glucosyltransferase enzyme can synthesize poly alpha-1,3-glucan having at least 95% alpha-1,3 glycosidic linkages and a weight average degree of polymerization ($DP_w$) of at least 100.

In another embodiment, modification step (b) comprises deleting at least one of motifs (i), (ii), or (iii) encoded by the polynucleotide sequence identified in step (a).

In another embodiment, the glucosyltransferase enzyme of step (b) comprises a catalytic domain that does not comprise at least one amino acid sequence that is at least 60% identical to SEQ ID NO:78, SEQ ID NO:79, or SEQ ID NO:80.

In another embodiment, the branched alpha-glucan polymer has an intrinsic viscosity and/or branching index that is reduced by at least 30% compared to the intrinsic viscosity and/or branching index of poly alpha-1,3-glucan synthesized by the parent glucosyltransferase.

In another embodiment, the identifying step is performed (a) in silico, (b) with a method comprising a nucleic acid hybridization step, (c) with a method comprising a protein sequencing step, and/or (d) with a method comprising a protein binding step; and/or wherein said modifying step is performed (e) in silico, followed by synthesis of the polynucleotide sequence encoding a glucosyltransferase enzyme that produces a branched alpha-glucan polymer, or (f) using a physical copy of the polynucleotide sequence encoding the parent glucosyltransferase.

Another embodiment concerns a polynucleotide sequence produced according to the above embodiment, optionally wherein the polynucleotide sequence further comprises one or more regulatory sequences operably linked to the polynucleotide sequence, preferably wherein the one or more regulatory sequences include a promoter sequence. Another embodiment concerns a glucosyltransferase enzyme encoded such a polynucleotide sequence.

Another embodiment concerns a reaction solution comprising water, sucrose, and a glucosyltransferase enzyme as disclosed herein.

Another embodiment concerns a method for producing a branched alpha-glucan polymer. This method comprises (a) contacting at least water, sucrose, and a glucosyltransferase enzyme as presently disclosed, whereby branched alpha-glucan polymer is produced, and b) optionally, isolating the branched alpha-glucan polymer produced in step (a).

Another embodiment concerns a branched alpha-glucan polymer produced from any glucan synthesis method or reaction disclosed herein, or that is a product of any glucosyltransferase enzyme disclosed herein.

BRIEF DESCRIPTION OF THE DRAWINGS AND SEQUENCES

FIG. 1: Comparison of the main chain tertiary fold of *Lactobacillus reuteri* GTF (gray) and *Streptococcus mutans* GTF (black). The structure of the *L. reuteri* GTF includes a fifth domain (Domain V) that was truncated from the structure of *S. mutans* GTF. The active site is also indicated and is formed by a cavity in the central domains (the so-called A and B domains); this location is based on spatial similarity with similar domains in alpha amylases. The amino acid sequence of the *S. mutans* 3AIE GTF structure is SEQ ID NO:66, and the amino acid sequence of the *L. reuteri* 3KLK GTF structure is SEQ ID NO:67.

Figure 2A:
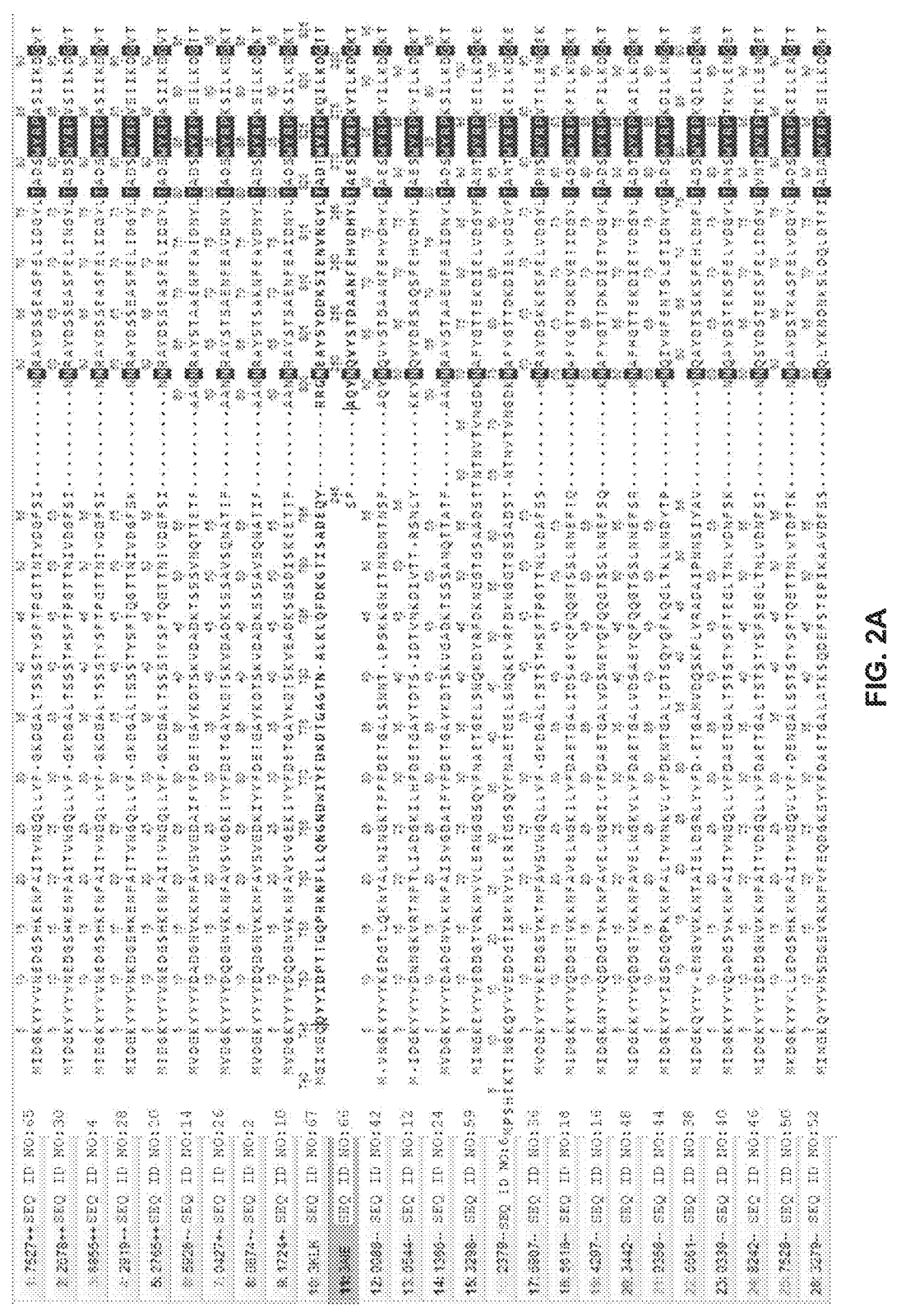
Figure 2B:
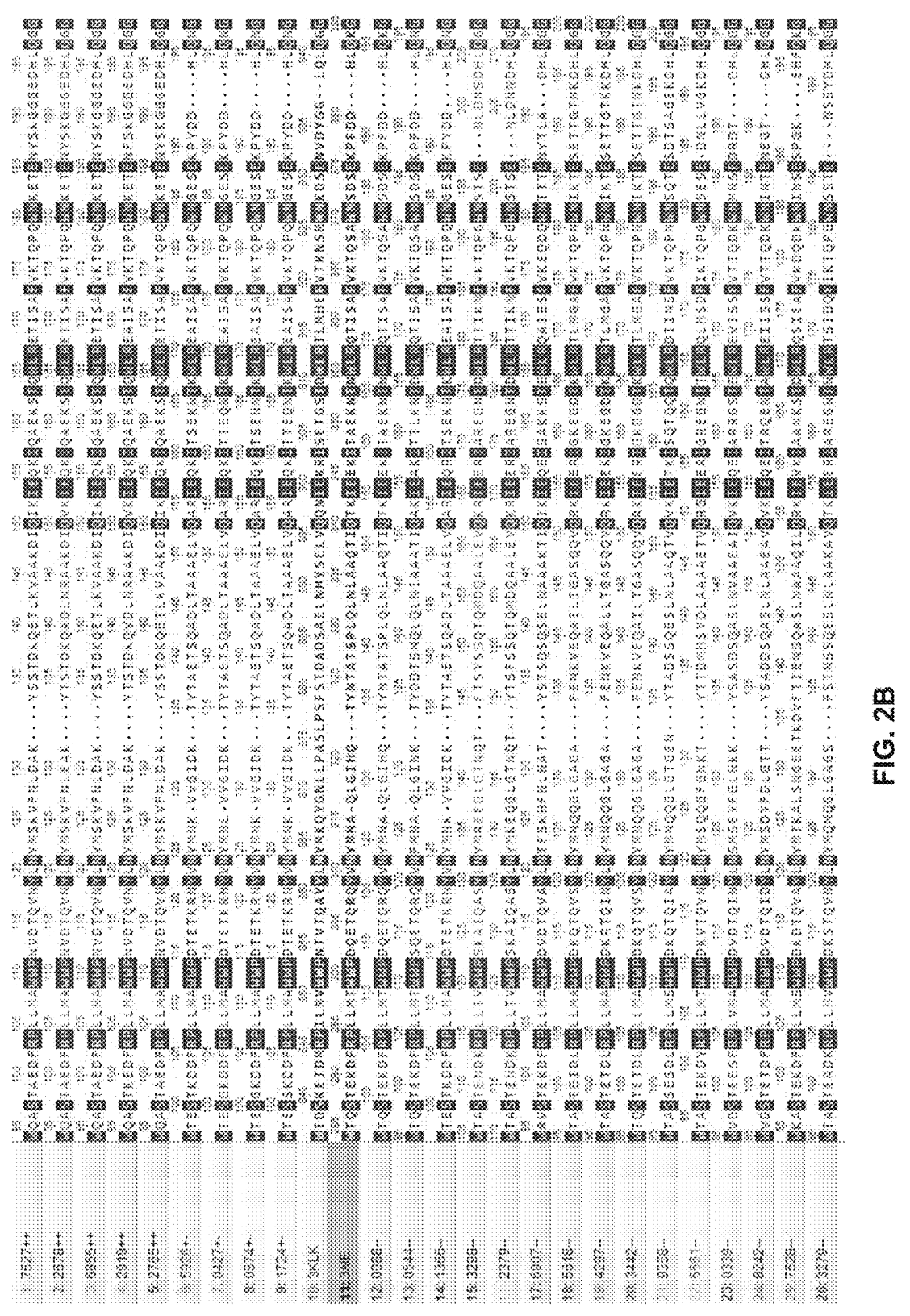
Figure 2C:
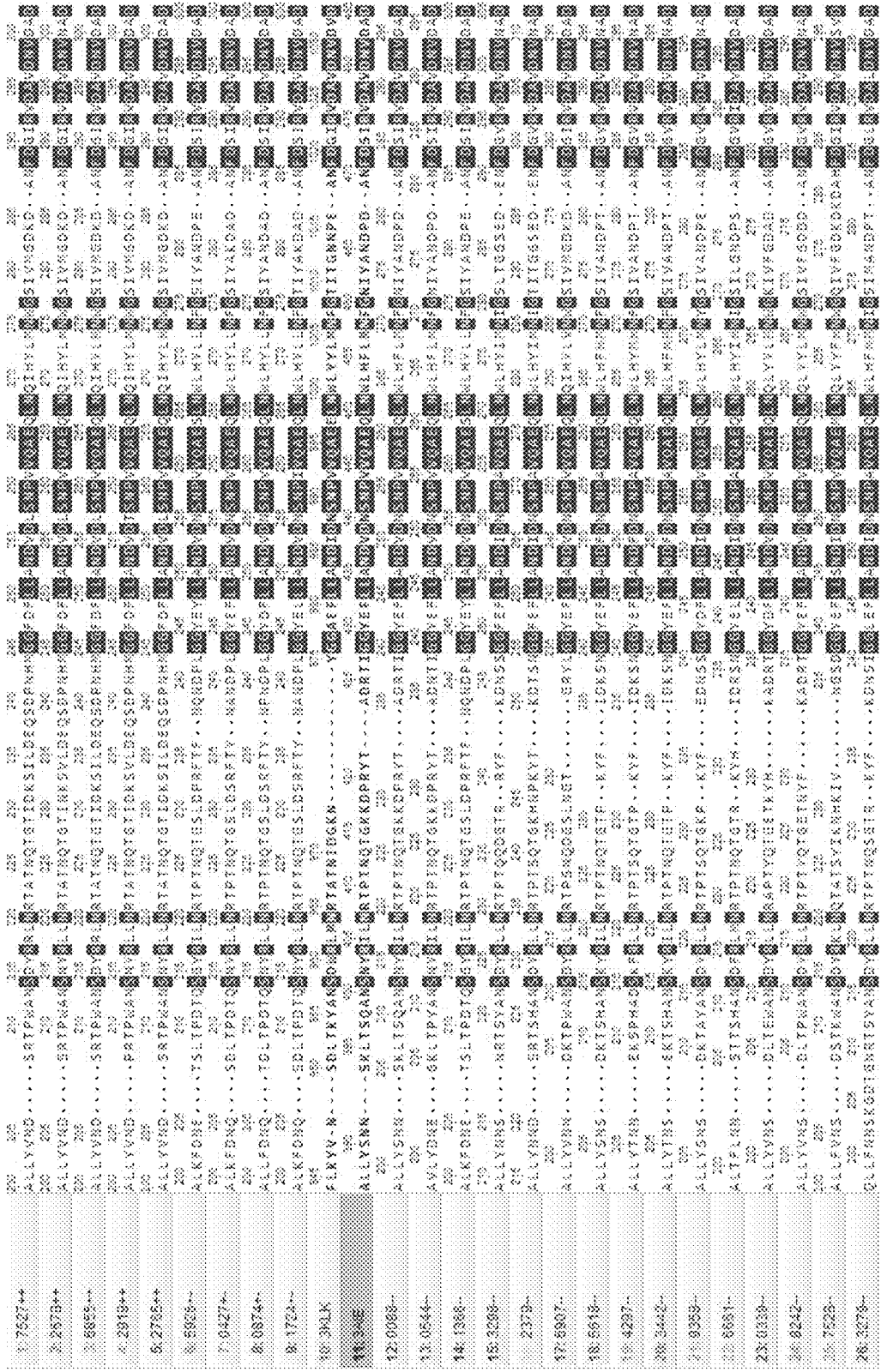
Figure 2D:
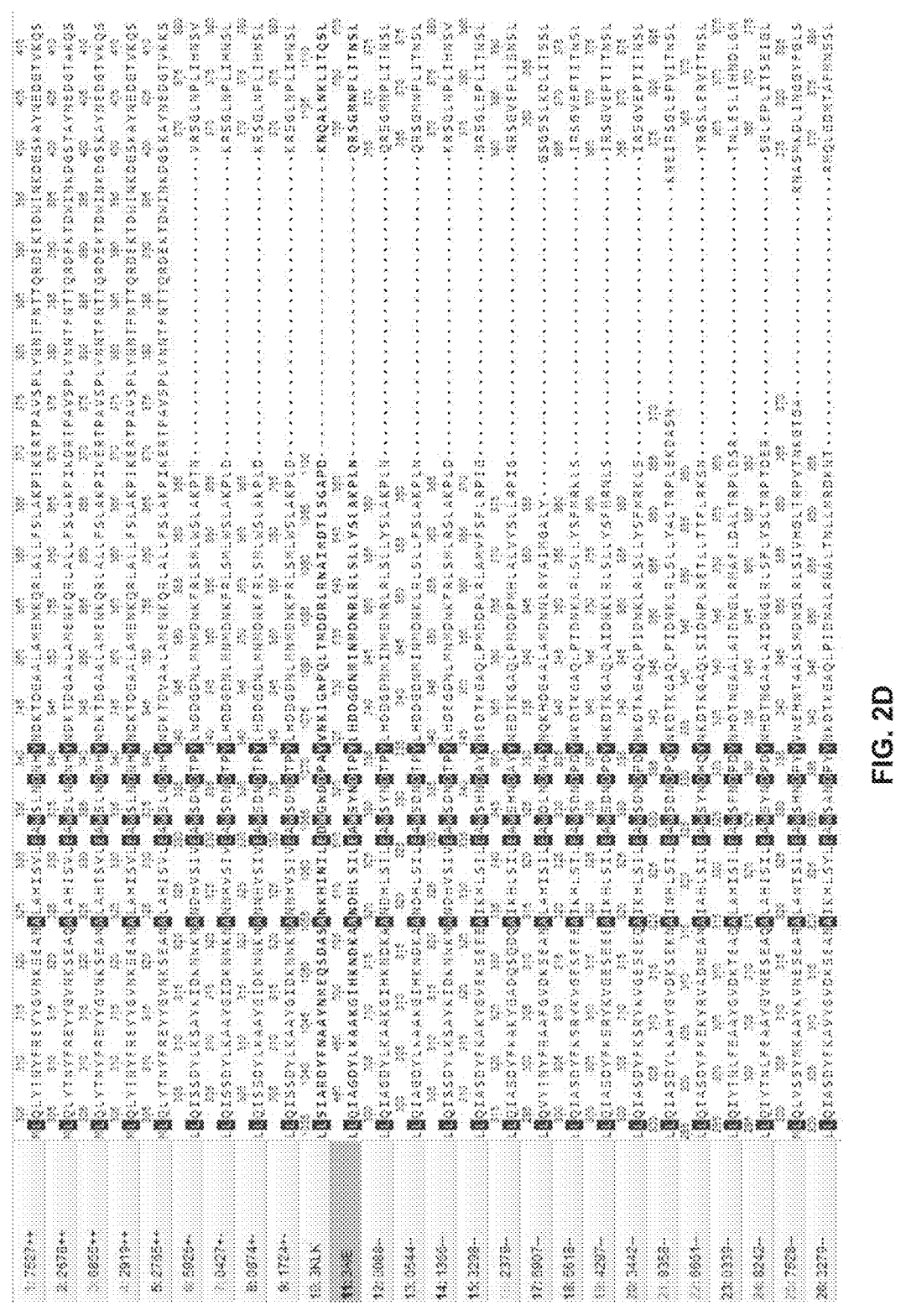
Figure 2E:
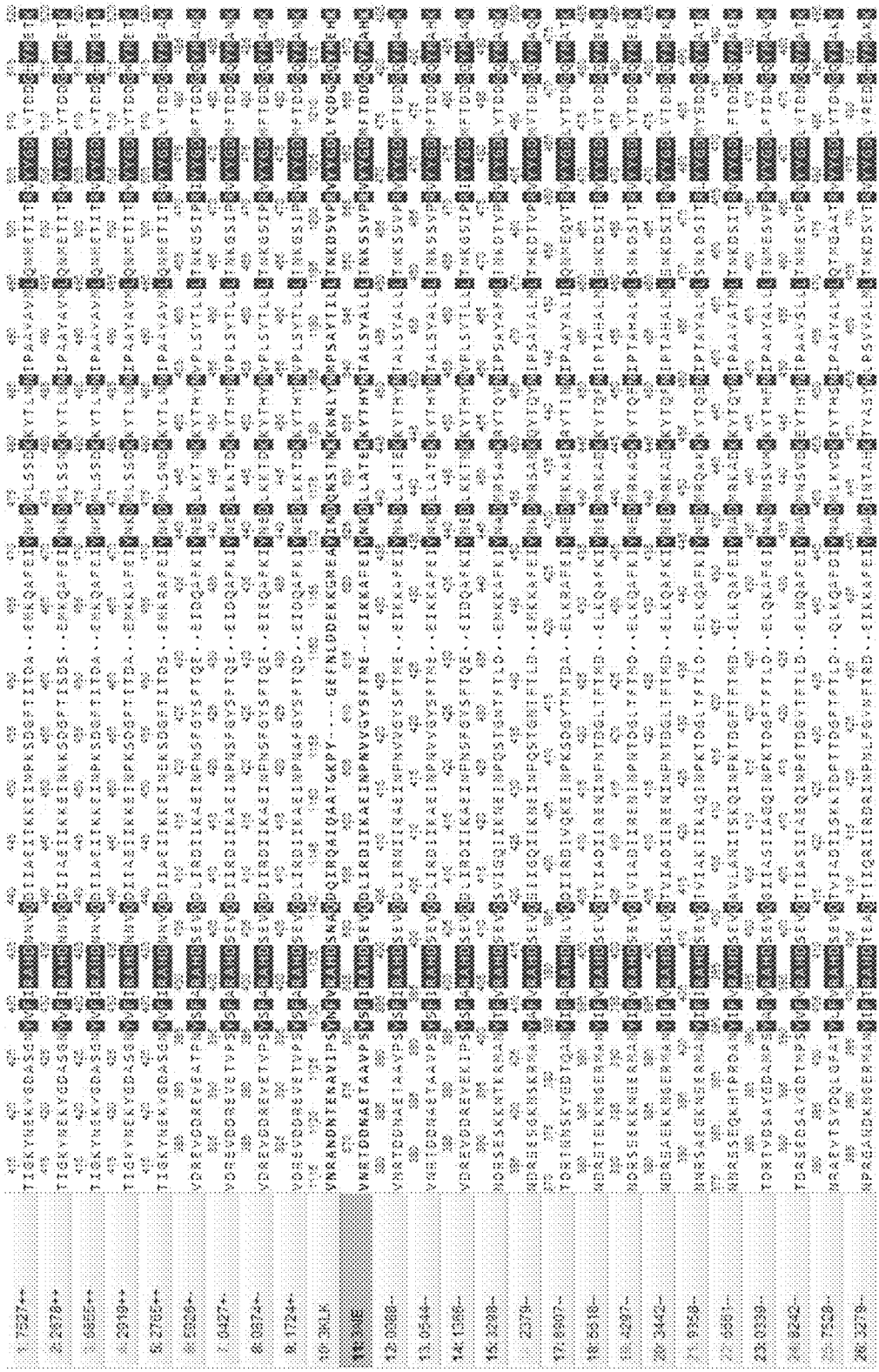
Figure 2F:
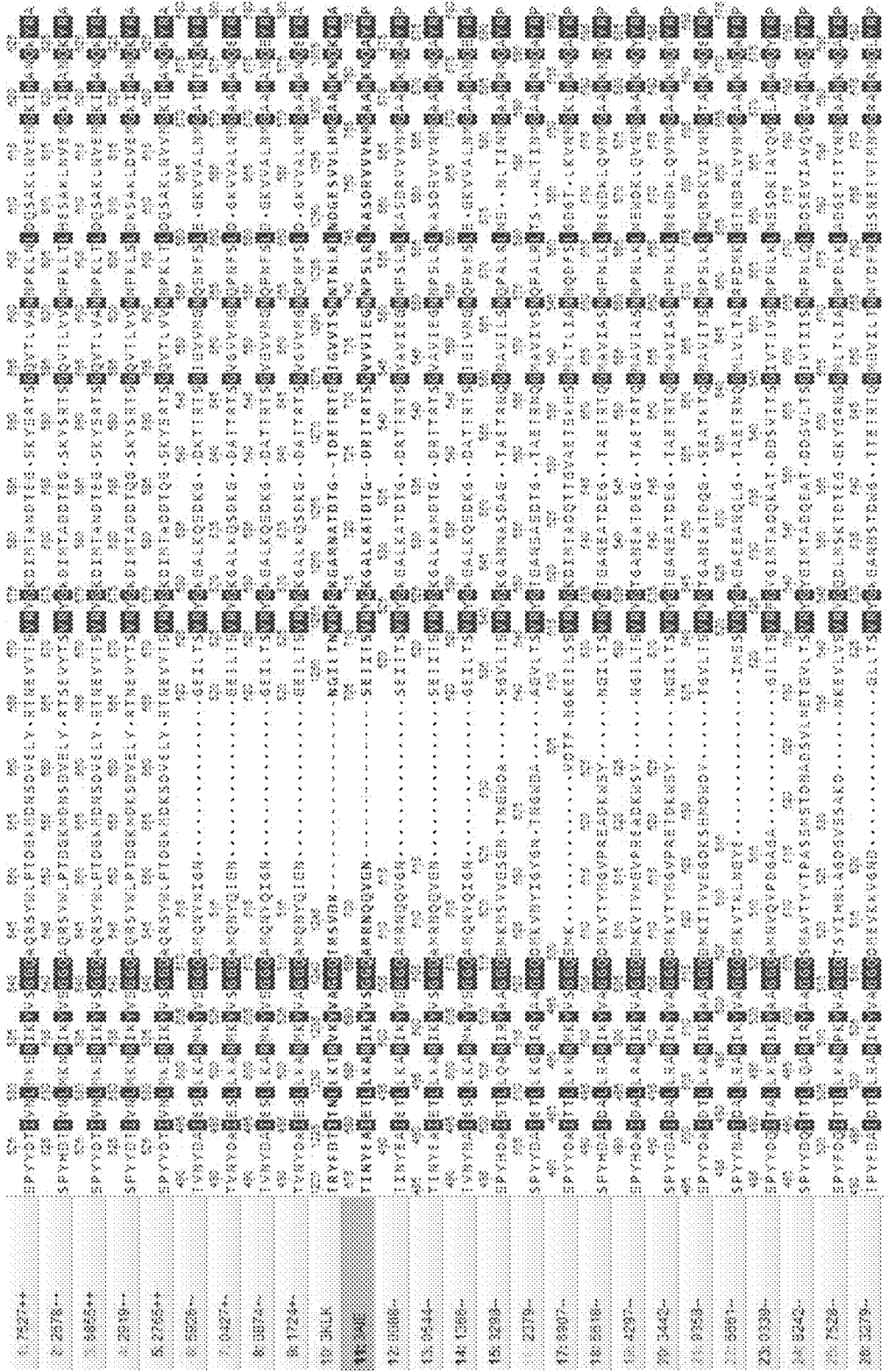
Figure 2G:
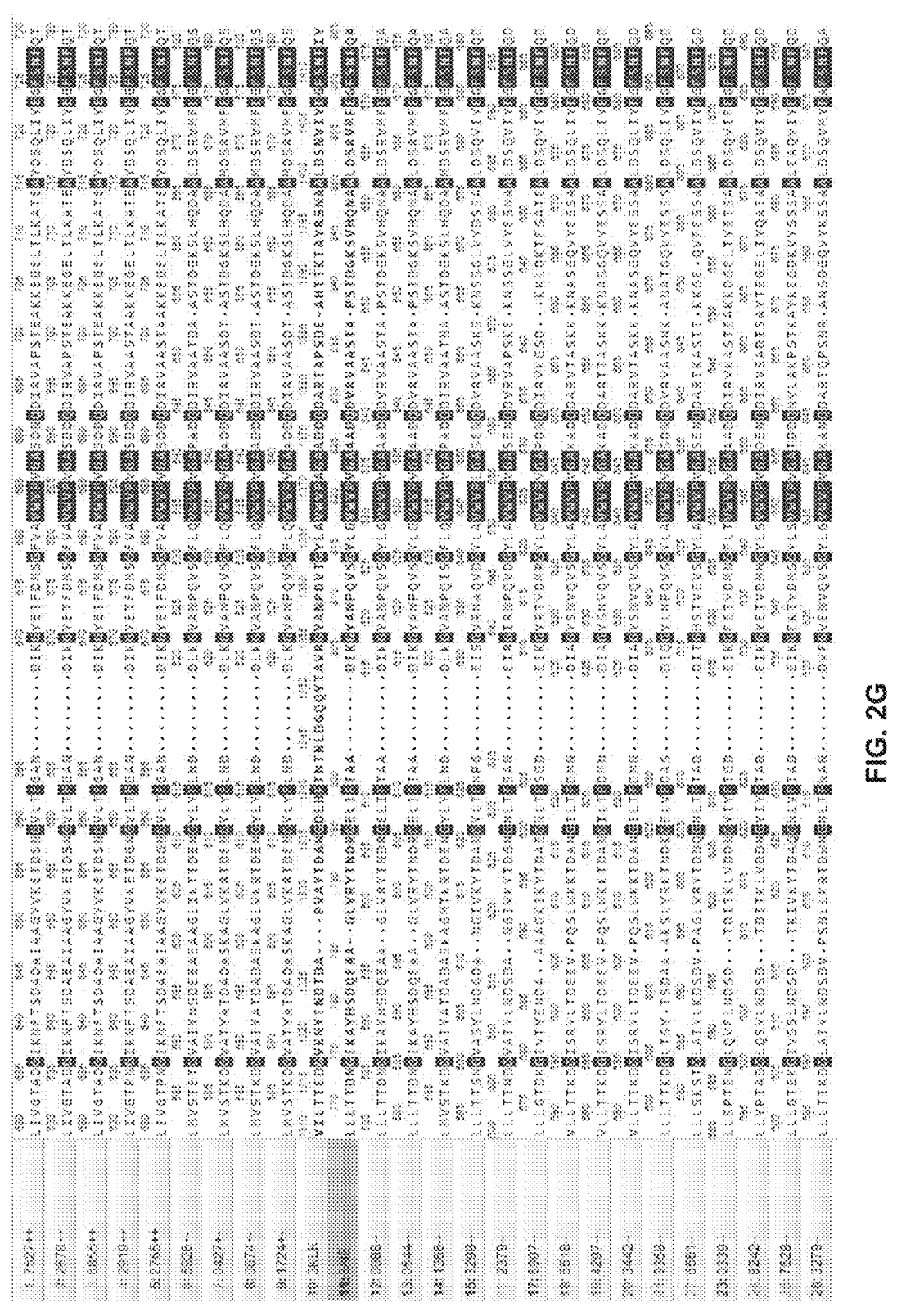
Figure 2H:
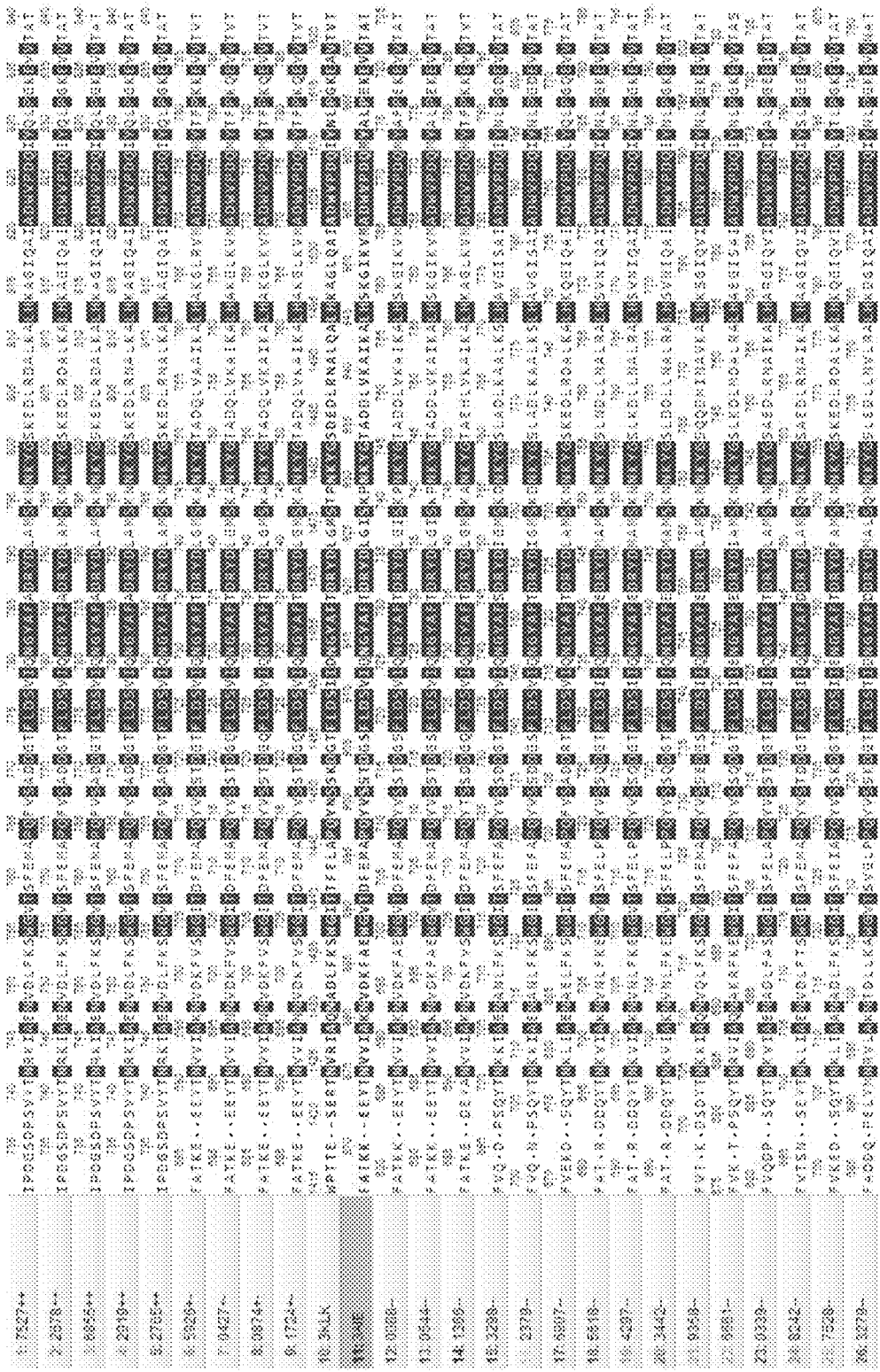
Figure 2J:
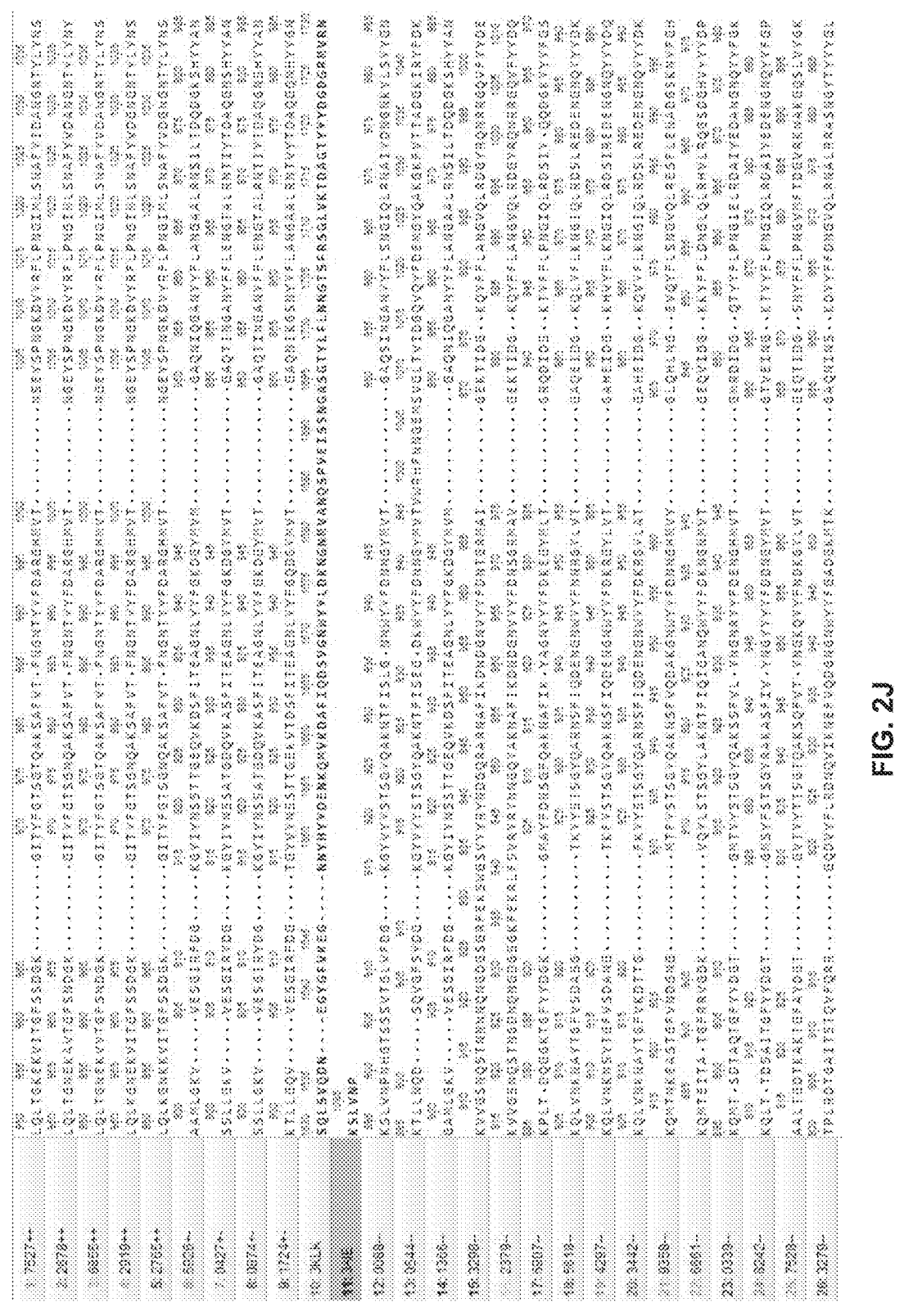
Figure 2K:
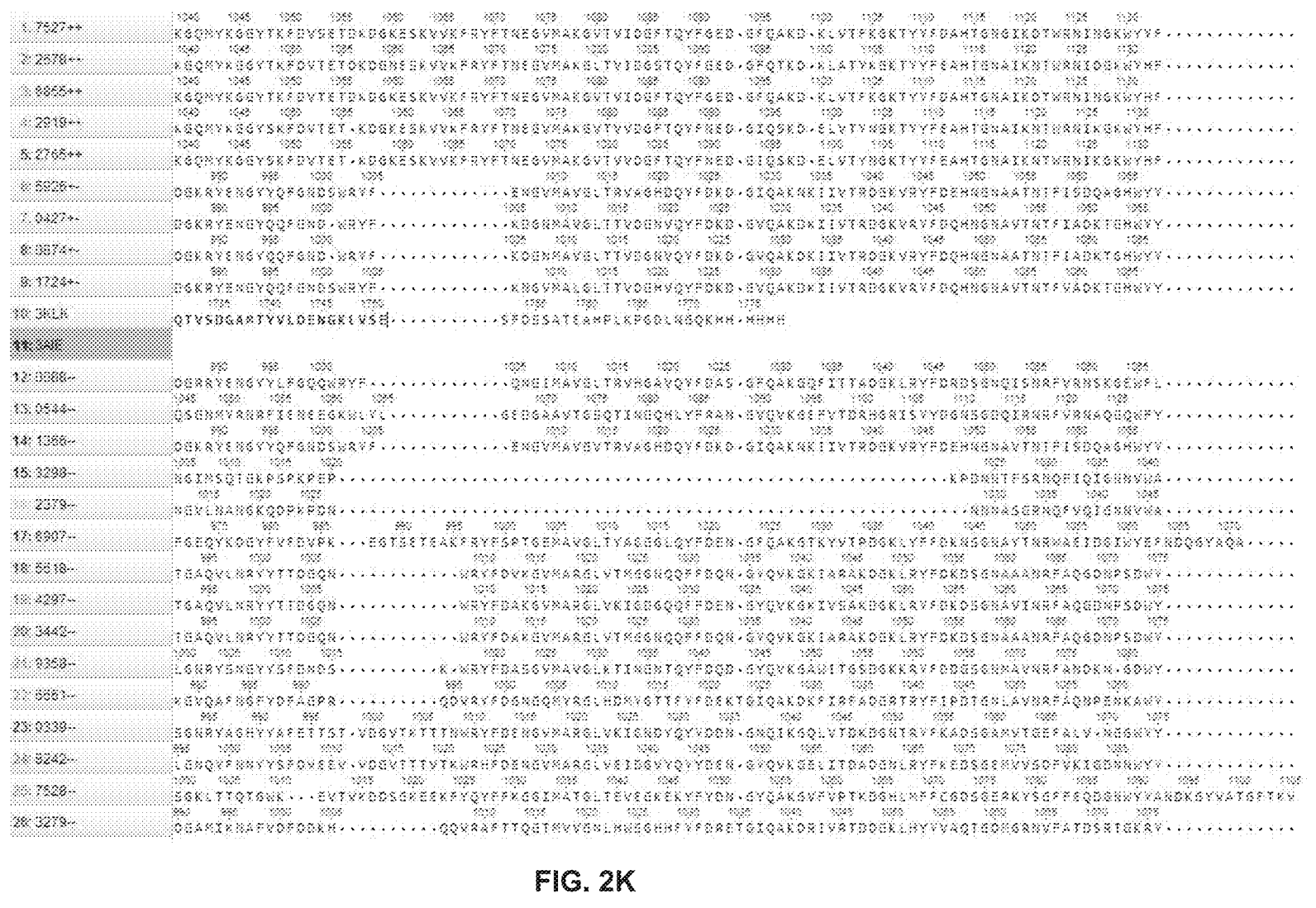
Figure 2L:
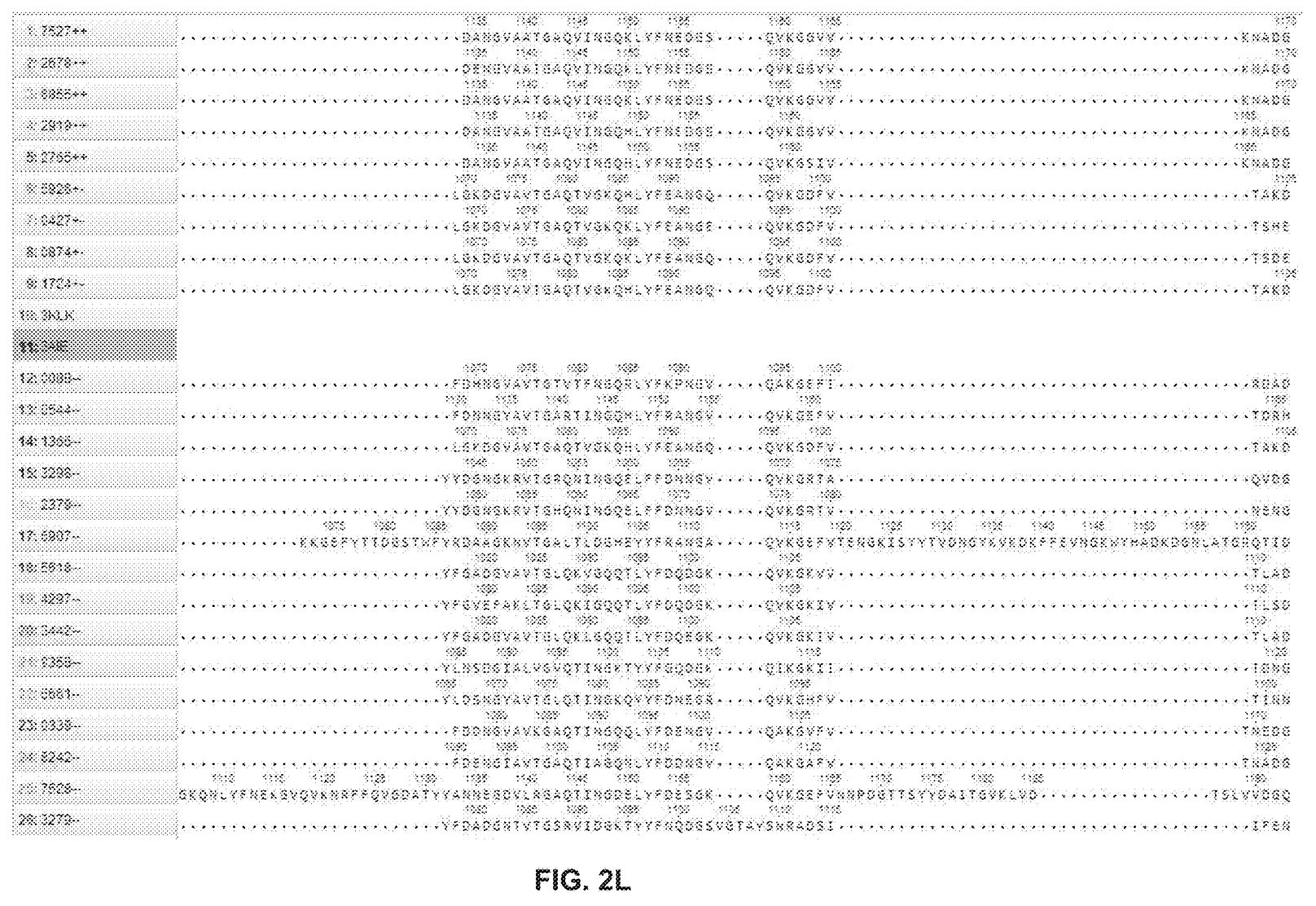
Figure 2M:
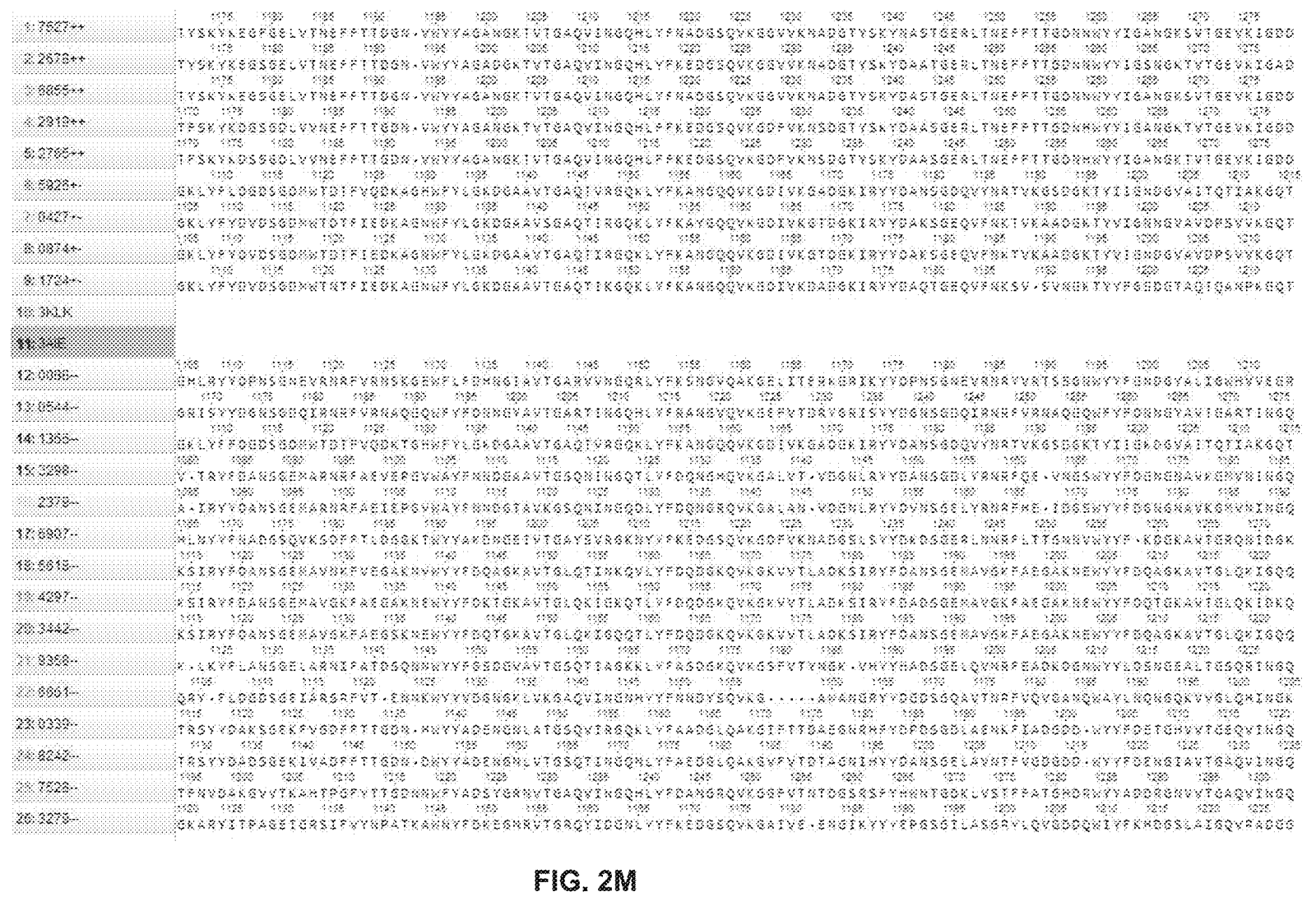
Figure 2N:
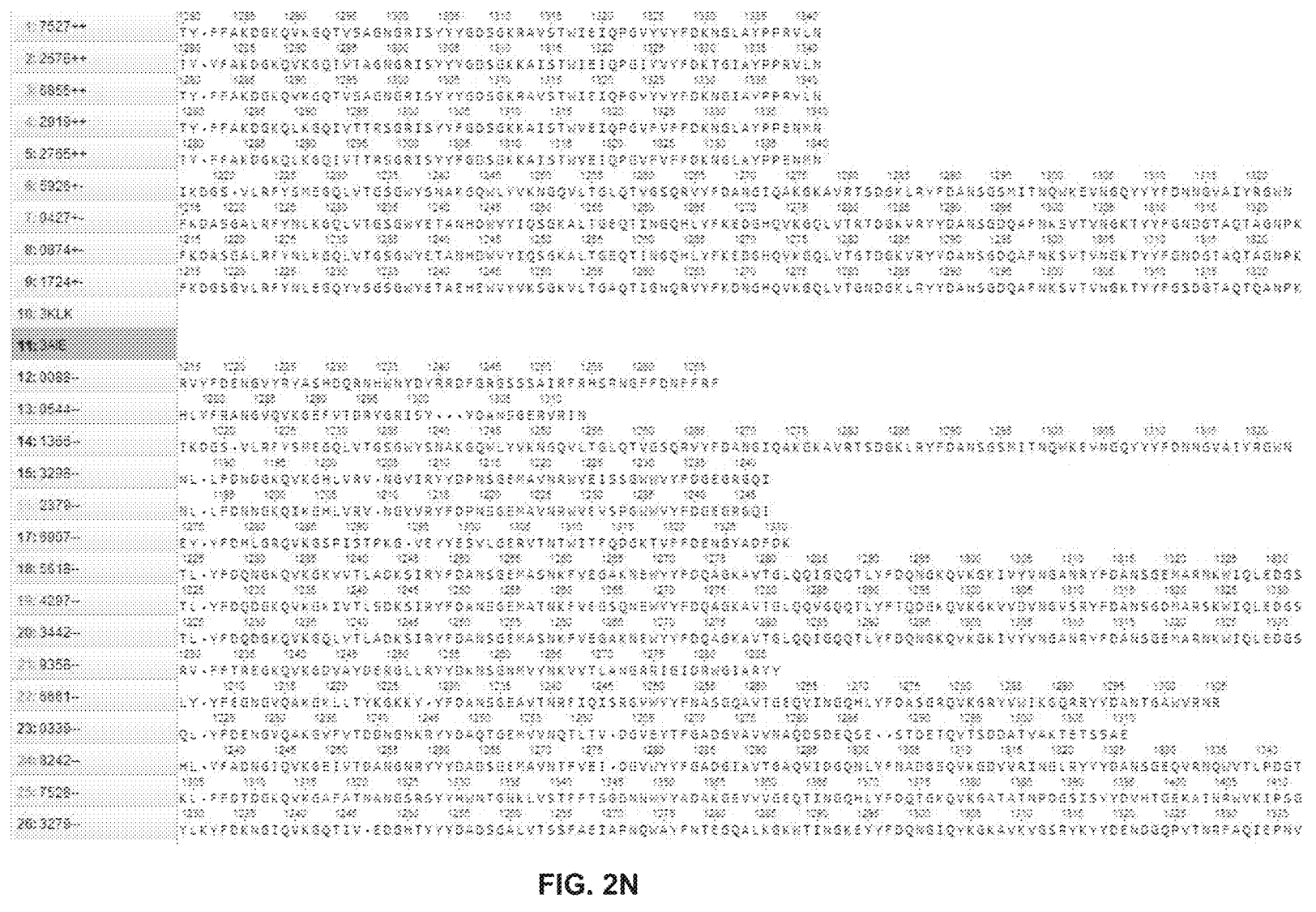

FIGS. 2A-O: Alignment of twenty-four GTF sequences with sequences of portions of GTFs from *S. mutans* (3AIE, SEQ ID NO:66) and *L. reuteri* (3KLK, SEQ ID NO:67) for which crystallographic structures are known; single-letter amino acid code is used. GTF amino acid sequences that produced glucan with 100% alpha-1,3 linkages and high molecular weight ($DP_w$ of at least 400 under the tested initial sucrose concentrations, see Table 4) are designated "++". Those GTFs producing glucan with 100% alpha-1,3 linkages and a $DP_w$ of at least 100 are designated "+−". Other GTFs producing glucan with mixed linkages are designated "−−".

Figure 3:
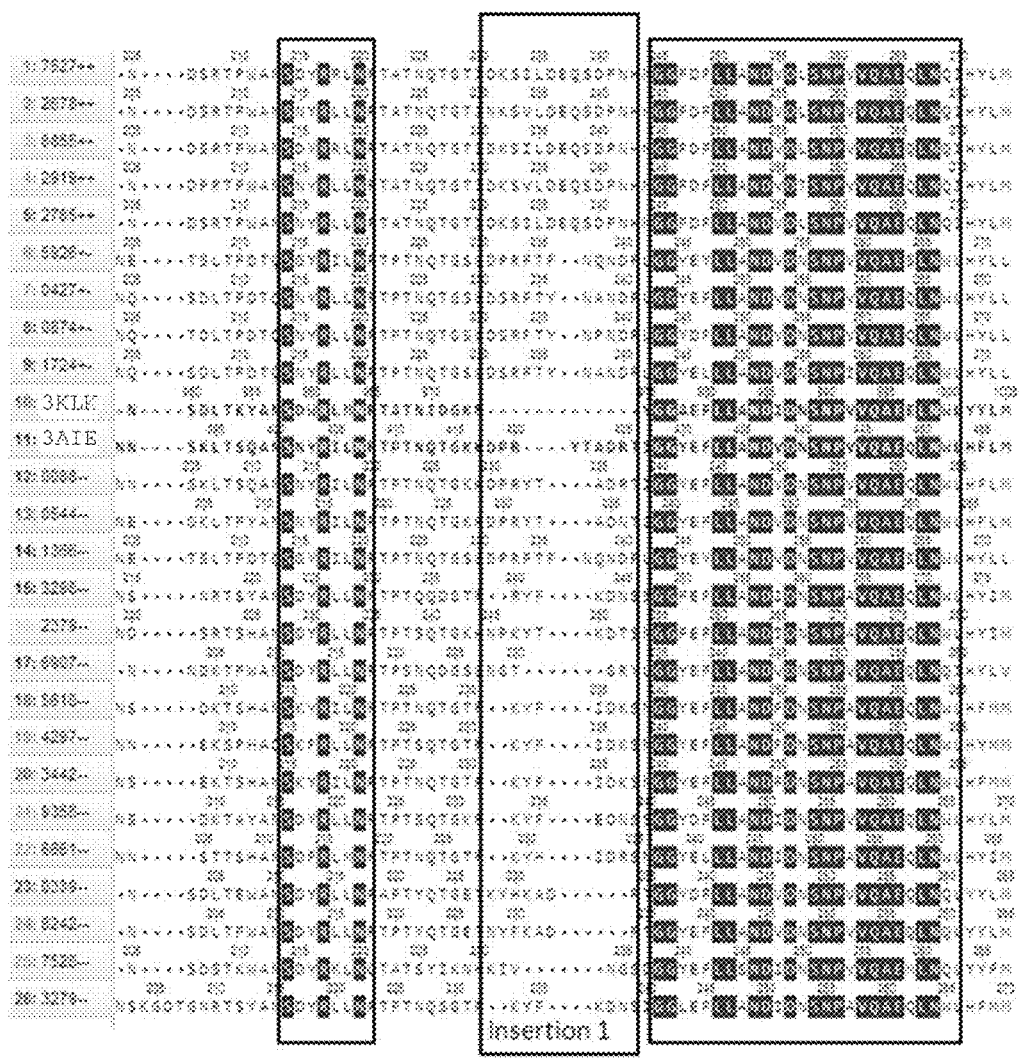

FIG. 3: The sequence of the tested GTF enzymes in the vicinity of Motifs 1a and 1b. The sequence region of Motifs 1a and 1b along with upstream and downstream flanking reference sequence motifs are shown as boxed regions. Motifs 1a and 1b are located in box labeled "Insertion 1". The alignment in this figure represents a portion of the alignment in FIGS. 2A-O.

Figure 4B:
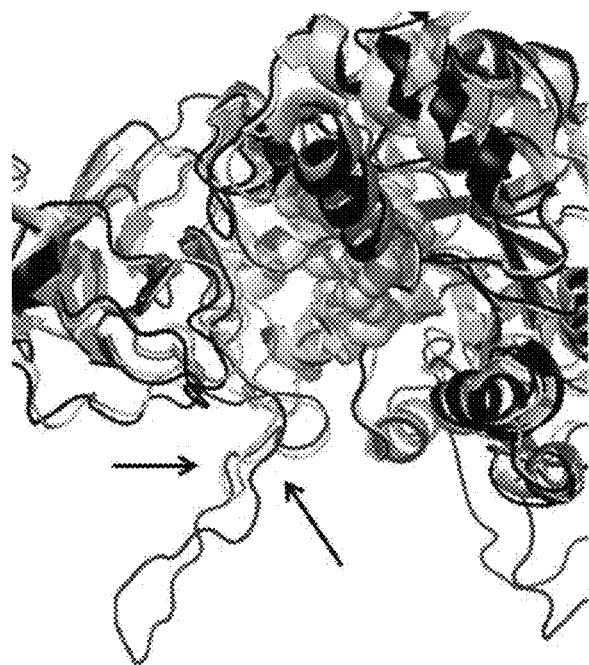
Figure 4A:
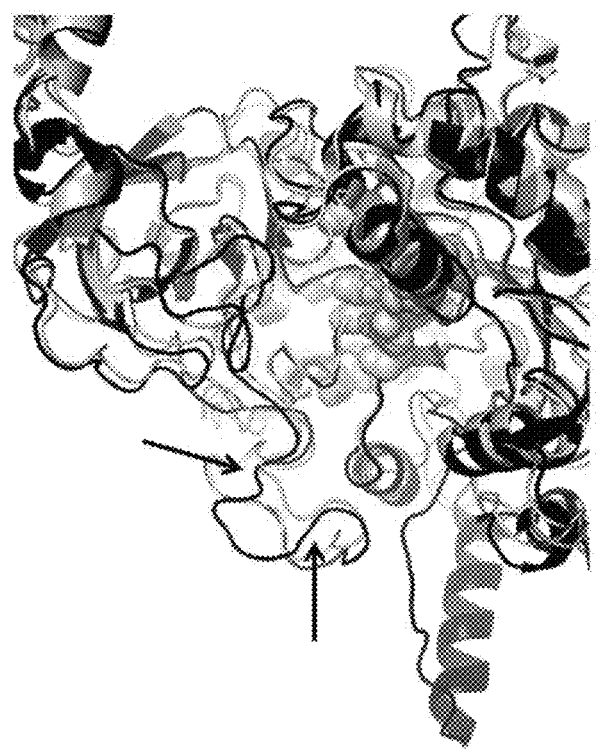

FIGS. 4A and 4B: Visualization of Motif 1a through comparison of a homology model of GTF 7527 (SEQ ID NO:65) based on the reference crystallographic structures of *S. mutans* (3AIE, SEQ ID NO:66) (FIG. 4A) and *L. reuteri* (3KLK, SEQ ID NO:67) (FIG. 4B). The main chain folding of the homology model in each view is shown with dark lines while the main chain folding of the reference structure is shown with lighter lines. The residues forming the catalytic sites in the reference crystallographic structures are shown as Van der Waals spheres for reference. Motif 1a (between the arrows) is presented in both homology models as an open loop (black) extending into the solvent as a consequence of there being no homologous segment to provide means to position with respect to the remainder of the GTF catalytic domain.

Figure 5:
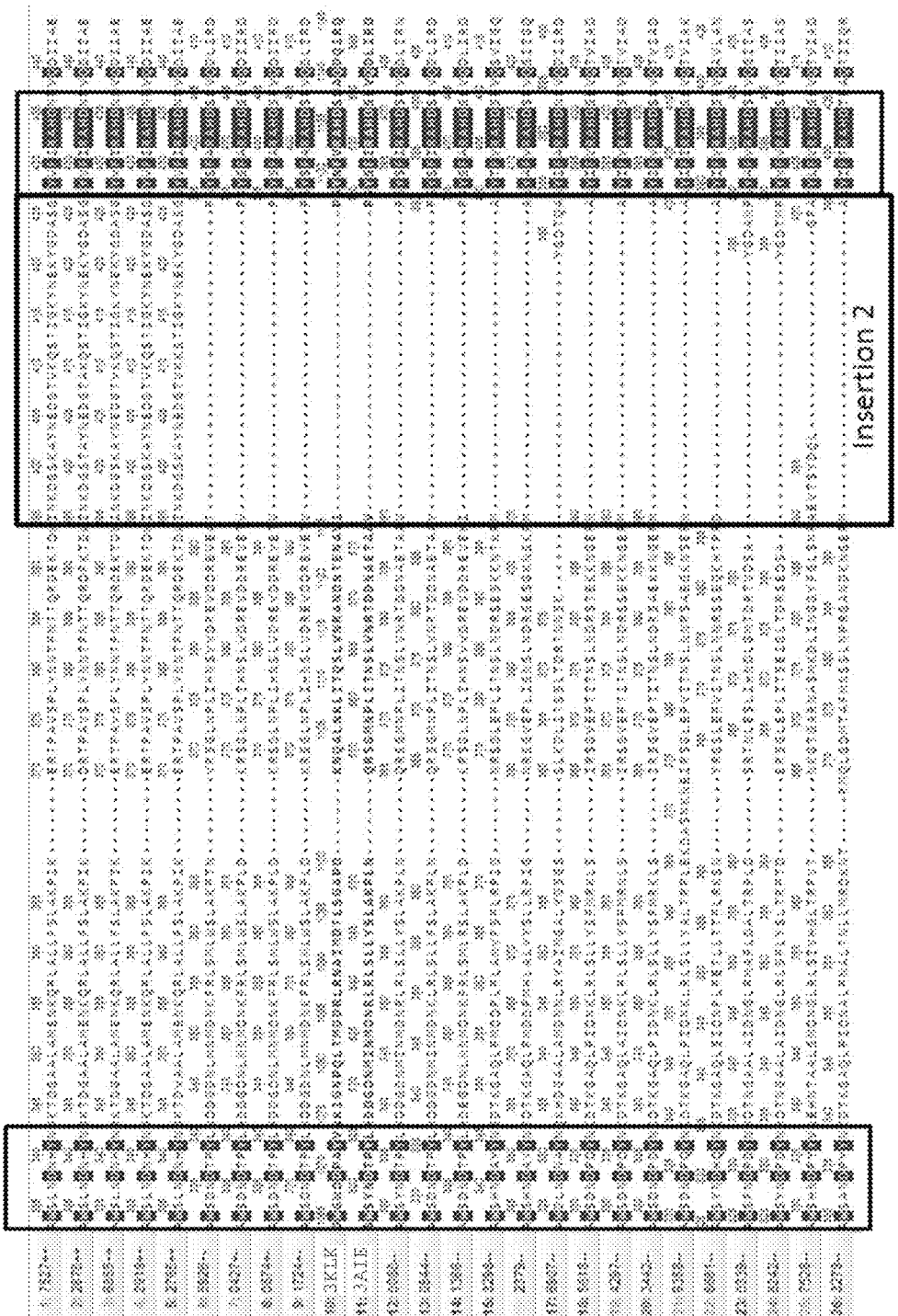

FIG. 5: The sequence of the tested GTF enzymes in the vicinity of Motif 2. The sequence region of Motif 2 along with upstream and downstream flanking reference sequence motifs are shown as boxed regions. Motif 2 is located in box labeled "Insertion 2". The alignment in this figure represents a portion of the alignment in FIGS. 2A-O.

Figure 6B:
Figure 6A:
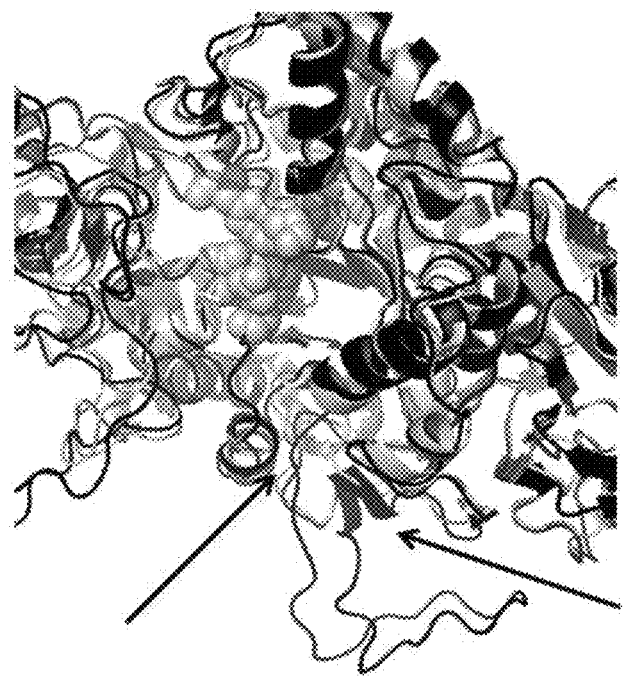

FIGS. 6A and 6B: Visualization of Motif 2 through comparison of a homology model of GTF 7527 (SEQ ID NO:65) based on the reference crystallographic structures of *S. mutans* (3AIE, SEQ ID NO:66) (FIG. 6A) and *L. reuteri* (3KLK, SEQ ID NO:67) (FIG. 6B). The main chain folding of the homology model in each view is shown with dark lines while the main chain folding of the reference structure is shown with lighter lines. The residues forming the catalytic sites in the reference crystallographic structures are shown as Van der Waals spheres for reference. Motif 2 (between the arrows) is presented in both homology models as an open loop (black) extending into the solvent as a consequence of there being no homologous segment to provide means to position with respect to the remainder of the GTF catalytic domain.

Figure 7:
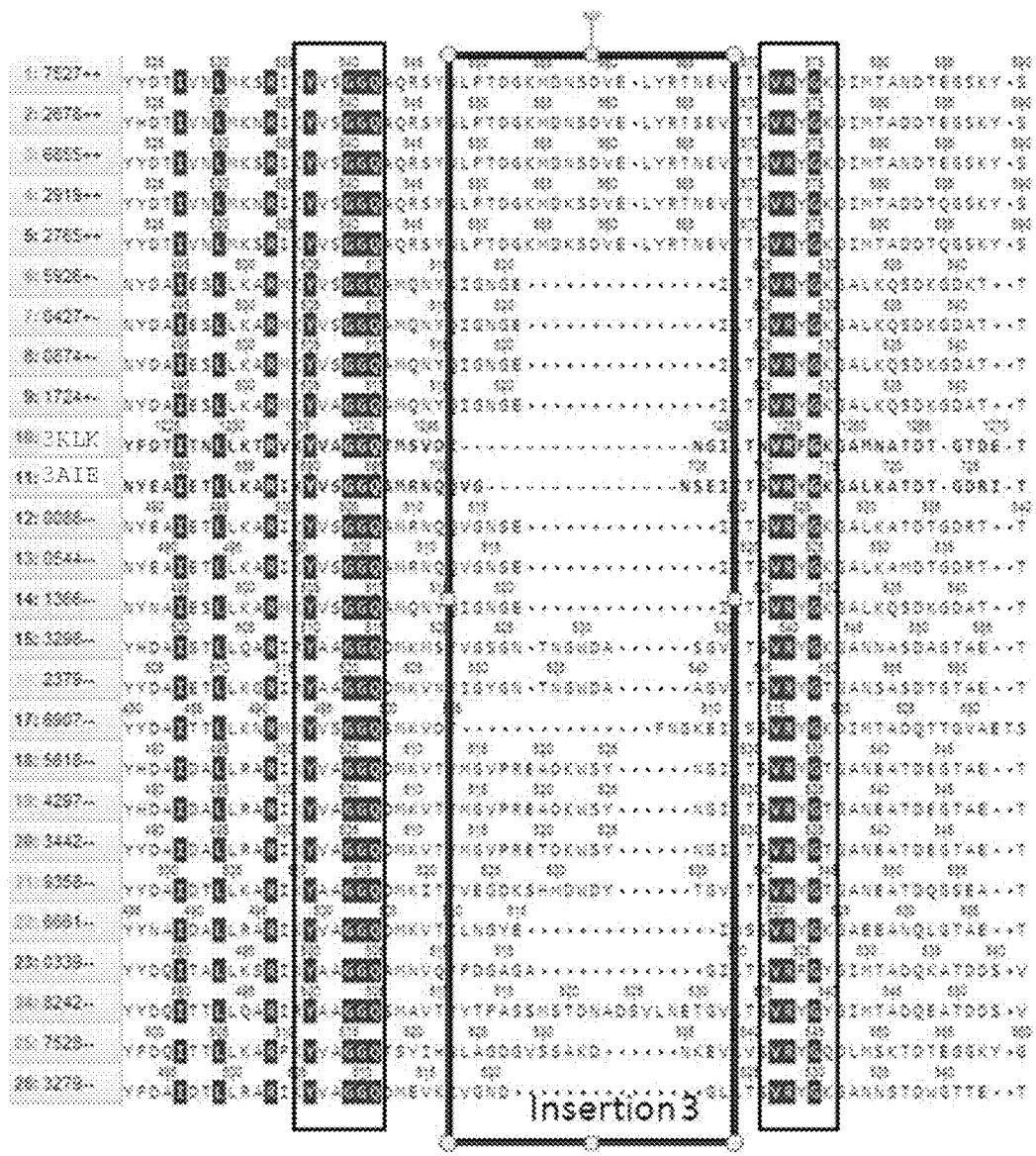

FIG. 7: The sequence of the tested GTF enzymes in the vicinity of Motifs 3a and 3b. The sequence region of Motifs 3a and 3b along with upstream and downstream flanking reference sequence motifs are shown as boxed regions. Motifs 3a and 3b are located in box labeled "Insertion 3". The alignment in this figure represents a portion of the alignment in FIGS. 2A-O.

Figure 8B:
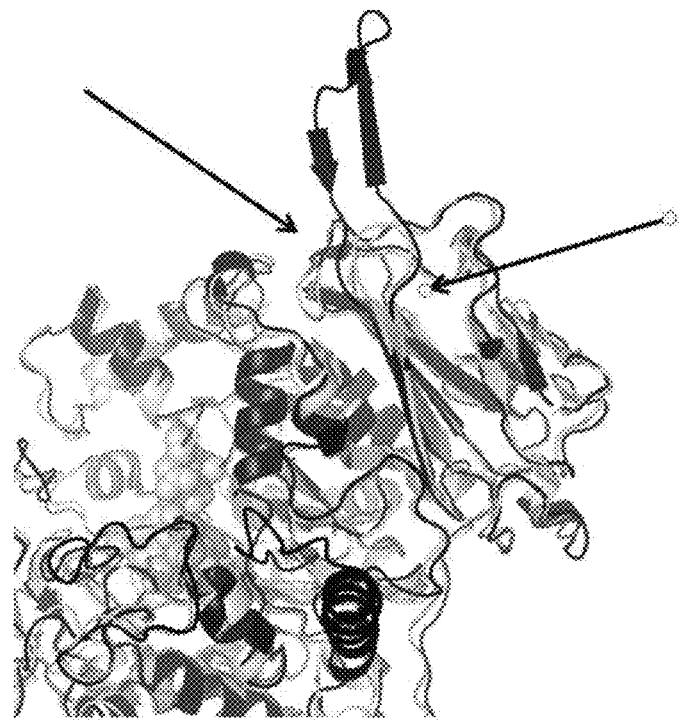
Figure 8A:
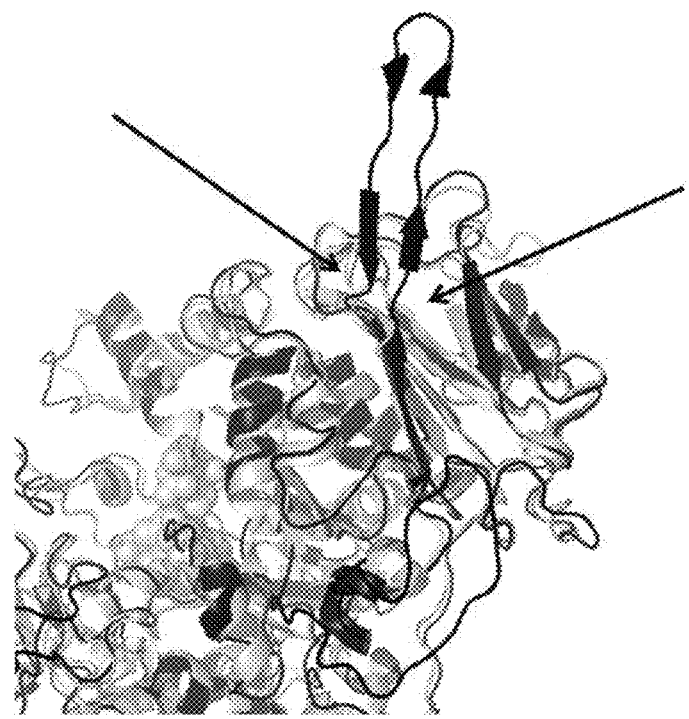

FIGS. 8A and 8B: Visualization of Motif 3a through comparison of a homology model of GTF 7527 (SEQ ID NO:65) based on the reference crystallographic structures of *S. mutans* (3AIE, SEQ ID NO:66) (FIG. 8A) and *L. reuteri* (3KLK, SEQ ID NO:67) (FIG. 8BA). The main chain folding of the homology model in each view is shown with dark lines while the main chain folding of the reference structure is shown with lighter lines. The residues forming the catalytic sites in the reference crystallographic structures are shown as Van der Waals spheres for reference. Motif 3a (between the arrows) is presented in both homology models as an open loop (black) extending into the solvent as a consequence of there being no homologous segment to provide means to position with respect to the remainder of the GTF catalytic domain.

TABLE 1

Summary of Nucleic Acid and Protein SEQ ID Numbers

| Description | Nucleic acid SEQ ID NO. | Protein SEQ ID NO. |
|---|---|---|
| "0874 GTF", *Streptococcus sobrinus*. DNA codon-optimized for expression in *E. coli*. The first 156 amino acids of the protein are deleted compared to GENBANK Identification No. 450874; a start methionine is included. | 1 | 2 (1435 aa) |
| "6855 GTF", *Streptococcus salivarius* SK126. DNA codon-optimized for expression in *E. coli*. The first 178 amino acids of the protein are deleted compared to GENBANK Identification No. 228476855; a start methionine is included. | 3 | 4 (1341 aa) |
| "2379 GTF", *Streptococcus salivarius*. DNA codon-optimized for expression in *E. coli*. The first 203 amino acids of the protein are deleted compared to GENBANK Identification No. 662379; a start methionine is included. | 5 | 6 (1247 aa) |
| "7527" or "GTFJ", *Streptococcus salivarius*. DNA codon-optimized for expression in *E. coli*. The first 42 amino acids of the protein are deleted compared to GENBANK Identification No. 47527; a start methionine is included. | 7 | 8 (1477 aa) |
| "1724 GTF", *Streptococcus downei*. DNA codon-optimized for expression in *E. coli*. The first 162 amino acids of the protein are deleted compared to GENBANK Identification No. 121724; a start methionine is included. | 9 | 10 (1436 aa) |
| "0544 GTF", *Streptococcus mutans*. DNA codon-optimized for expression in *E. coli*. The first 164 amino acids of the protein are deleted compared to GENBANK Identification No. 290580544; a start methionine is included. | 11 | 12 (1313 aa) |
| "5926 GTF", *Streptococcus dentirousetti*. DNA codon-optimized for expression in *E. coli*. The first 144 amino acids of the protein are deleted compared to GENBANK Identification No. 167735926; a start methionine is included. | 13 | 14 (1323 aa) |
| "4297 GTF", *Streptococcus oralis*. DNA codon-optimized for expression in *E. coli*. The first 228 amino acids of the protein are deleted compared to GENBANK Identification No. 7684297; a start methionine is included. | 15 | 16 (1348 aa) |
| "5618 GTF", *Streptococcus sanguinis*. DNA codon-optimized for expression in *E. coli*. The first 223 amino acids of the protein are deleted compared to GENBANK Identification No. 328945618; a start methionine is included. | 17 | 18 (1348 aa) |
| "2765 GTF", unknown *Streptococcus* sp. 0150. DNA codon-optimized for expression in *E. coli*. The first 193 amino acids of the protein are deleted compared to GENBANK Identification No. 322372765; a start methionine is included. | 19 | 20 (1340 aa) |
| "4700 GTF", *Leuconostoc mesenteroides*. DNA codon-optimized for expression in *E. coli*. The first 36 amino acids of the protein are deleted compared to GENBANK Identification No. 21654700; a start methionine is included. | 21 | 22 (1492 aa) |
| "1366 GTF", *Streptococcus criceti*. DNA codon-optimized for expression in *E. coli*. The first 139 amino acids of the protein are deleted compared to GENBANK Identification No. 146741366; a start methionine is included. | 23 | 24 (1323 aa) |

TABLE 1-continued

Summary of Nucleic Acid and Protein SEQ ID Numbers

| Description | Nucleic acid SEQ ID NO. | Protein SEQ ID NO. |
|---|---|---|
| "0427 GTF", *Streptococcus sobrinus*. DNA codon-optimized for expression in *E. coli*. The first 156 amino acids of the protein are deleted compared to GENBANK Identification No. 940427; a start methionine is included. | 25 | 26 (1435 aa) |
| "2919 GTF", *Streptococcus salivarius* PS4. DNA codon-optimized for expression in *E. coli*. The first 92 amino acids of the protein are deleted compared to GENBANK Identification No. 383282919; a start methionine is included. | 27 | 28 (1340 aa) |
| "2678 GTF", *Streptococcus salivarius* K12. DNA codon-optimized for expression in *E. coli*. The first 188 amino acids of the protein are deleted compared to GENBANK Identification No. 400182678; a start methionine is included. | 29 | 30 (1341 aa) |
| "2381 GTF", *Streptococcus salivarius*. DNA codon-optimized for expression in *E. coli*. The first 273 amino acids of the protein are deleted compared to GENBANK Identification No. 662381; a start methionine is included. | 31 | 32 (1305 aa) |
| "3929 GTF", *Streptococcus salivarius* JIM8777. DNA codon-optimized for expression in *E. coli*. The first 178 amino acids of the protein are deleted compared to GENBANK Identification No. 387783929; a start methionine is included. | 33 | 34 (1341 aa) |
| "6907 GTF", *Streptococcus salivarius* SK126. DNA codon-optimized for expression in *E. coli*. The first 161 amino acids of the protein are deleted compared to GENBANK Identification No. 228476907; a start methionine is included. | 35 | 36 (1331 aa) |
| "6661 GTF", *Streptococcus salivarius* SK126. DNA codon-optimized for expression in *E. coli*. The first 265 amino acids of the protein are deleted compared to GENBANK Identification No. 228476661; a start methionine is included. | 37 | 38 (1305 aa) |
| "0339 GTF", *Streptococcus gallolyticus* ATCC 43143. DNA codon-optimized for expression in *E. coli*. The first 213 amino acids of the protein are deleted compared to GENBANK Identification No. 334280339; a start methionine is included. | 39 | 40 (1310 aa) |
| "0088 GTF", *Streptococcus mutans*. DNA codon-optimized for expression in *E. coli*. The first 189 amino acids of the protein are deleted compared to GENBANK Identification No. 3130088; a start methionine is included. | 41 | 42 (1267 aa) |
| "9358 GTF", *Streptococcus mutans* UA159. DNA codon-optimized for expression in *E. coli*. The first 176 amino acids of the protein are deleted compared to GENBANK Identification No. 24379358; a start methionine is included. | 43 | 44 (1287 aa) |
| "8242 GTF", *Streptococcus gallolyticus* ATCC BAA-2069. DNA codon-optimized for expression in *E. coli*. The first 191 amino acids of the protein are deleted compared to GENBANK Identification No. 325978242; a start methionine is included. | 45 | 46 (1355 aa) |
| "3442 GTF", *Streptococcus sanguinis* SK405. DNA codon-optimized for expression in *E. coli*. The first 228 amino acids of the protein are deleted compared to GENBANK Identification No. 324993442; a start methionine is included. | 47 | 48 (1348 aa) |

TABLE 1-continued

Summary of Nucleic Acid and Protein SEQ ID Numbers

| Description | Nucleic acid SEQ ID NO. | Protein SEQ ID NO. |
|---|---|---|
| "7528 GTF", *Streptococcus salivarius*. DNA codon-optimized for expression in *E. coli*. The first 173 amino acids of the protein are deleted compared to GENBANK Identification No. 47528; a start methionine is included. | 49 | 50 (1427 aa) |
| "3279 GTF", *Streptococcus* sp. 0150. DNA codon-optimized for expression in *E. coli*. The first 178 amino acids of the protein are deleted compared to GENBANK Identification No. 322373279; a start methionine is included. | 51 | 52 (1393 aa) |
| "6491 GTF", *Leuconostoc citreum* KM20. DNA codon-optimized for expression in *E. coli*. The first 244 amino acids of the protein are deleted compared to GENBANK Identification No. 170016491; a start methionine is included. | 53 | 54 (1262 aa) |
| "6889 GTF", *Streptococcus salivarius* SK126. DNA codon-optimized for expression in *E. coli*. The first 173 amino acids of the protein are deleted compared to GENBANK Identification No. 228476889; a start methionine is included. | 55 | 56 (1427 aa) |
| "4154 GTF", *Lactobacillus reuteri*. DNA codon-optimized for expression in *E. coli*. The first 38 amino acids of the protein are deleted compared to GENBANK Identification No. 51574154. | 57 | 58 (1735 aa) |
| "3298 GTF", *Streptococcus* sp. 0150. The first 209 amino acids of the protein are deleted compared to GENBANK Identification No. 322373298; a start methionine is included. | 59 | (1242 aa) |
| Wild type GTFJ, *Streptococcus salivarius*. GENBANK Identification No. 47527. |  | 60 (1518 aa) |
| Wild type GTF corresponding to 2678 GTF, *Streptococcus salivarius* K12. |  | 61 (1528 aa) |
| Wild type GTF corresponding to 6855 GTF, *Streptococcus salivarius* SK126. |  | 62 (1518 aa) |
| Wild type GTF corresponding to 2919 GTF, *Streptococcus salivarius* PS4. |  | 63 (1431 aa) |
| Wild type GTF corresponding to 2765 GTF, *Streptococcus* sp. 0150. |  | 64 (1532 aa) |
| Shorter version of 7527, *Streptococcus salivarius*, (also referred to as "7527-NT" herein. The first 178 amino acids of the protein are deleted compared to GENBANK Identification No. 47527; a start methionine is included. |  | 65 (1341 aa) |
| "3AIE", portion of a GTF from *Streptococcus mutans* as annotated in the Protein Data Bank under pdb entry no. 3AIE. |  | 66 (844 aa) |
| "3KLK", portion of a GTF from *Lactobacillus reuteri* as annotated in the Protein Data Bank under pdb entry no. 3KLK. |  | 67 (1039 aa) |
| Catalytic active site motif FDxxRxDAxDNV |  | 68 (12 aa) |
| Catalytic active site motif ExWxxxDxxY |  | 69 (10 aa) |
| Catalytic active site motif FxRAHD |  | 70 (6 aa) |
| Catalytic active site motif IxNGYAF |  | 71 (7 aa) |

TABLE 1-continued

Summary of Nucleic Acid and Protein SEQ ID Numbers

| Description | Nucleic acid SEQ ID NO. | Protein SEQ ID NO. |
|---|---|---|
| Motif SxxRxxN upstream of Motifs 1a and 1b | | 72 (7 aa) |
| Motif GGxxxLLxNDxDxSNPxVQAExLN downstream of Motifs 1a and 1b | | 73 (24 aa) |
| Motif WxxxDxxY upstream of Motif 2 | | 74 (8 aa) |
| Motif YxFxRAHD downstream of Motif 2 | | 75 (8 aa) |
| Motif YxxGGQ upstream of Motifs 3a and 3b | | 76 (6 aa) |
| Motif VRxG downstream of Motifs 3a and 3b | | 77 (4 aa) |
| Motif 1a: D/N-K-S-I/V-L-D-E-Q-S-D-P-N-H (motif i) | | 78 (13 aa) |
| Motif 2: N-K-D-G-S-K/T-A-Y-N-E-D-G-T-V/A-K-Q/K-S-T-I-G-K-Y-N-E-K-Y-G-D-A-S (motif ii) | | 79 (30 aa) |
| Motif 3a: L-P-T-D-G-K-M-D-N/K-S-D-V-E-L-Y-R-T-N/S-E (motif iii) | | 80 (19 aa) |
| Motif 1b: D-S/P-R-F-T-Y/F-N-A/Q/P-N-D-P | | 81 (11 aa) |
| Motif 3b: I-G-N-G-E | | 82 (5 aa) |
| Wild type GTF corresponding to 5926 GTF, Streptococcus dentirousetti. | | 83 (1466 aa) |
| "7527-NT-dlS1a", GTF lacking Motif 1a. DNA codon-optimized for expression in E. coli. | 84 | 85 (1325 aa) |
| "7527-NT-dlS2", GTF lacking Motif 2. DNA codon-optimized for expression in E. coli. | 86 | 87 (1311 aa) |
| "7527-NT-dlS3a", GTF lacking Motif 3a. DNA codon-optimized for expression in E. coli. | 88 | 89 (1319 aa) |
| "7527-NT-dlS1a,2", GTF lacking Motifs 1a and 2. DNA codon-optimized for expression in E. coli. | 90 | 91 (1295 aa) |
| "7527-NT-dlS1a,3a", GTF lacking Motifs 1a and 3a. DNA codon-optimized for expression in E. coli. | 92 | 93 (1303 aa) |
| "7527-NT-dlS2,3a", GTF lacking Motifs 2 and 3a. DNA codon-optimized for expression in E. coli. | 94 | 95 (1289 aa) |
| "7527-NT-dlS1a,2,3a", GTF lacking Motifs 1a, 2 and 3a. DNA codon-optimized for expression in E. coli. | 96 | 97 (1273 aa) |

DETAILED DESCRIPTION

The disclosures of all patent and non-patent literature cited herein are incorporated herein by reference in their entirety.

Unless otherwise disclosed, the terms "a" and "an" as used herein are intended to encompass one or more (i.e., at least one) of a referenced feature.

Where present, all ranges are inclusive and combinable, except as otherwise noted. For example, when a range of "1 to 5" is recited, the recited range should be construed as including ranges "1 to 4", "1 to 3", "1-2", "1-2 & 4-5", "1-3 & 5", and the like.

The terms "alpha-glucan", "alpha-glucan polymer" and the like are used interchangeably herein. An alpha-glucan is a polymer comprising glucose monomeric units linked together by alpha-glycosidic linkages.

The terms "branched alpha-glucan", "branched alpha-glucan polymer" and the like are used interchangeably herein. A branched alpha-glucan in some aspects can have an intrinsic viscosity and/or branching index that is reduced by at least about 30% compared to poly alpha-1,3-glucan that is completely or mostly unbranched. A branched alpha-glucan is believed to contain at least both alpha-1,3 and alpha-1,6 glycosidic linkages (e.g., less than 95% alpha-1,3 glycosidic linkages, and more than 5% alpha-1,6-glycosidic linkages), for example. In some aspects, a branch point occurs on average at least every 5 monosaccharide units in a branched alpha-glucan herein.

The terms "glycosidic linkage", "glycosidic bond" and the like are used interchangeably herein and refer to the covalent bond that joins a carbohydrate (sugar) molecule to another group such as another carbohydrate. The term "alpha-glycosidic linkage" as used herein refers to the type of glycosidic linkage that joins alpha-D-glucose molecules to each other. The glycosidic linkages of an alpha-glucan herein can also be referred to as "glucosidic linkages". Herein, "alpha-D-glucose" will be referred to as "glucose".

The terms "poly alpha-1,3-glucan", "alpha-1,3-glucan polymer" and the like are used interchangeably herein. Poly alpha-1,3-glucan herein comprises at least 95% alpha-1,3-glycosidic linkages. Poly alpha-1,3-glucan that comprises 95%, 96%, 97%, 98%, or 99% alpha-1,3-glycosidic linkages is expected to be mostly unbranched, and that comprising 100% alpha-1,3-glycosidic linkages is linear/unbranched.

The term "intrinsic viscosity" as used herein refers to a measure of the contribution of a glucan polymer (e.g., branched alpha-glucan) to the viscosity of a liquid (e.g., solution) comprising the glucan polymer. Intrinsic viscosity can be measured, for example using the methodology disclosed in the Examples below, or as disclosed by Weaver et al. (*J. Appl. Polym. Sci.* 35:1631-1637) and Chun and Park (*Macromol. Chem. Phys.* 195:701-711), for example.

The terms "branching index", "branching ratio" and the like (can be denoted as g') are used interchangeably herein, and refer to the ratio of hydrodynamic volume of a branched polymer chain with a given molar mass, to the hydrodynamic volume of a linear polymer chain with the same molar mass. Branched polymer has a smaller size in solution than its linear counterpart with the same molar mass. Thus, the branching ratio is a useful measure of the overall branching frequency in a polydispersed polymer. Branching index can be measured, for example using the methodology disclosed in the Examples below, or as disclosed by Zdunek et al. (*Food Bioprocess Technol.* 7:3525-3535) and Herget et al. (*BMC Struct. Biol.* 8:35).

The term "sucrose" herein refers to a non-reducing disaccharide composed of an alpha-D-glucose molecule and a beta-D-fructose molecule linked by an alpha-1,2-glycosidic bond. Sucrose is known commonly as table sugar.

The terms "glucosyltransferase enzyme", "GTF enzyme", "GTF", "glucansucrase" and the like are used interchangeably herein. The activity of a GTF enzyme herein catalyzes the reaction of the substrate sucrose to make the product alpha-glucan and fructose. Other products (byproducts) of a GTF reaction can include glucose, various soluble gluco-oligosaccharides (DP2-DP7), and leucrose. Wild type forms of GTF enzymes generally contain (in the N-terminal to C-terminal direction) a signal peptide, a variable domain, a catalytic domain, and a glucan-binding domain. A GTF herein is classified under the glycoside hydrolase family 70 (GH70) according to the CAZy (Carbohydrate-Active EnZymes) database (Cantarel et al., *Nucleic Acids Res.* 37:D233-238, 2009).

The term "glucosyltransferase catalytic domain" herein refers to the domain of a glucosyltransferase enzyme that provides alpha-glucan-synthesizing activity to a glucosyltransferase enzyme. A glucosyltransferase catalytic domain preferably does not require the presence of any other domains to have this activity.

The term "parent glucosyltransferase" herein refers to a glucosyltransferase comprising a catalytic domain having (a) an amino acid sequence that is at least 90% identical to amino acid positions 54-957 of SEQ ID NO:65, positions 55-960 of SEQ ID NO:30, positions 55-960 of SEQ ID NO:4, positions 55-960 of SEQ ID NO:28, and/or positions 55-960 of SEQ ID NO:20, and (b) a motif comprising an amino acid sequence that is at least 90% identical to SEQ ID NO:78, a motif comprising an amino acid sequence that is at least 90% identical to SEQ ID NO:79, and a motif comprising an amino acid sequence that is at least 90% identical to SEQ ID N0:80. A parent glucosyltransferase herein typically synthesizes poly alpha-1,3-glucan.

A "reaction solution" as used herein generally refers to a solution comprising sucrose, water, at least one active glucosyltransferase enzyme, and optionally other components. A reaction solution can alternatively be referred to herein as a "glucan synthesis reaction", "glucan reaction", "GTF reaction", or "reaction composition", for example. Other components that can be in a glucan synthesis reaction include fructose, glucose, leucrose, and soluble gluco-oligosaccharides (e.g., DP2-DP7). It is in a reaction solution where the step of contacting water, sucrose and a glucosyltransferase enzyme is performed. The term "under suitable reaction conditions" as used herein refers to reaction conditions that support conversion of sucrose to poly alpha-glucan via glucosyltransferase enzyme activity. A reaction solution as claimed herein is not believed to be naturally occurring.

The "percent dry solids" of a reaction solution refers to the wt % of all the sugars in the glucan synthesis reaction. The percent dry solids of a reaction solution can be calculated, for example, based on the amount of sucrose used to prepare the reaction.

The "yield" of alpha-glucan by a reaction solution herein represents the weight of alpha-glucan product expressed as a percentage of the weight of sucrose substrate that is converted in the reaction. For example, if 100 g of sucrose in a reaction solution is converted to products, and 10 g of the products is alpha-glucan, the yield of the alpha-glucan would be 10%. This yield calculation can be considered as a measure of selectivity of the reaction toward alpha-glucan.

The term "motif" herein refers to a distinctive and recurring structural unit, such as within an amino acid sequence. By "recurring" it is meant that a motif occurs in multiple related polypeptides, for example.

The term "motif (i)" as used herein refers to an amino acid sequence comprising a sequence that is at least 90% identical to SEQ ID NO:78 (Motif 1a, Table 1).

The term "motif (ii)" as used herein refers to an amino acid sequence comprising a sequence that is at least 90% identical to SEQ ID NO:79 (Motif 2, Table 1).

The term "motif (iii)" as used herein refers to an amino acid sequence comprising a sequence that is at least 90% identical to SEQ ID NO:80 (Motif 3a, Table 1).

The terms "percent by volume", "volume percent", "vol %", "v/v %" and the like are used interchangeably herein. The percent by volume of a solute in a solution can be determined using the formula: [(volume of solute)/(volume of solution)]×100%.

The terms "percent by weight", "weight percentage (wt %)", "weight-weight percentage (% w/w)" and the like are used interchangeably herein. Percent by weight refers to the percentage of a material on a mass basis as it is comprised in a composition, mixture, or solution.

The terms "polynucleotide", "polynucleotide sequence", "nucleic acid sequence", "nucleotide sequence" and the like are used interchangeably herein. A polynucleotide may be a polymer of DNA or RNA that is single- or double-stranded, that optionally contains synthetic, non-natural or altered nucleotide bases. A polynucleotide may be comprised of one or more segments of cDNA, genomic DNA, synthetic DNA, or mixtures thereof. Nucleotides (ribonucleotides or deoxyribonucleotides) can be referred to by a single letter designation as follows: "A" for adenylate or deoxyadenylate (for RNA or DNA, respectively), "C" for cytidylate or deoxycytidylate (for RNA or DNA, respectively), "G" for guanylate or deoxyguanylate (for RNA or DNA, respectively), "U" for uridylate (for RNA), "T" for deoxythymidylate (for DNA), "R" for purines (A or G), "Y" for pyrimidines (C or T), "K" for G or T, "H" for A or C or T, "I" for inosine, "W" for A or T, and "N" for any nucleotide (e.g., N can be A, C, T, or G, if referring to a DNA sequence; N can be A, C, U, or G, if referring to an RNA sequence).

The term "gene" as used herein refers to a DNA polynucleotide sequence that expresses an RNA (RNA is transcribed from the DNA polynucleotide sequence) from a coding region, which RNA can be a messenger RNA (encoding a protein) or a non-protein-coding RNA. A gene may refer to the coding region alone, or may include regulatory sequences upstream and/or downstream to the coding region (e.g., promoters, 5'-untranslated regions, 3'-transcription terminator regions). A coding region encoding a protein can alternatively be referred to herein as an "open reading frame" (ORF). A gene that is "native" or "endogenous" refers to a gene as found in nature with its own regulatory sequences; such a gene is located in its natural location in the genome of a host cell. A "chimeric" gene refers to any gene that is not a native gene, comprising regulatory and coding sequences that are not found together in nature (i.e., the regulatory and coding regions are heterologous with each other). Accordingly, a chimeric gene may comprise regulatory sequences and coding sequences that are derived from different sources, or regulatory sequences and coding sequences derived from the same source, but arranged in a manner different than that found in nature. A "foreign" or "heterologous" gene refers to a gene that is introduced into the host organism by gene transfer. Foreign/heterologous genes can comprise native genes inserted into a non-native organism, native genes introduced into a new location within the native host, or chimeric genes. Polynucleotide sequences in certain embodiments herein are heterologous. A "transgene" is a gene that has been introduced into the genome by a gene delivery procedure (e.g., transformation). A "codon-optimized" open reading frame has its frequency of codon usage designed to mimic the frequency of preferred codon usage of the host cell.

A "non-native" amino acid sequence or polynucleotide sequence herein comprised in a cell or organism herein does not occur in a native (natural) counterpart of such cell or organism.

"Regulatory sequences" as used herein refer to nucleotide sequences located upstream of a gene's transcription start site (e.g., promoter), 5' untranslated regions, introns, and 3' non-coding regions, and which may influence the transcription, processing or stability, and/or translation of an RNA transcribed from the gene. Regulatory sequences herein may include promoters, enhancers, silencers, 5' untranslated leader sequences, introns, polyadenylation recognition sequences, RNA processing sites, effector binding sites, stem-loop structures, and other elements involved in regulation of gene expression. One or more regulatory elements herein may be heterologous to a coding region herein.

A "promoter" as used herein refers to a DNA sequence capable of controlling the transcription of RNA from a gene. In general, a promoter sequence is upstream of the transcription start site of a gene. Promoters may be derived in their entirety from a native gene, or be composed of different elements derived from different promoters found in nature, or even comprise synthetic DNA segments. Promoters that cause a gene to be expressed in a cell at most times under all circumstances are commonly referred to as "constitutive promoters". One or more promoters herein may be heterologous to a coding region herein.

A "strong promoter" as used herein refers to a promoter that can direct a relatively large number of productive initiations per unit time, and/or is a promoter driving a higher level of gene transcription than the average transcription level of the genes in a cell.

The terms "3' non-coding sequence", "transcription terminator", "terminator" and the like as used herein refer to DNA sequences located downstream of a coding sequence. This includes polyadenylation recognition sequences and other sequences encoding regulatory signals capable of affecting mRNA processing or gene expression.

As used herein, a first nucleic acid sequence is "hybridizable" to a second nucleic acid sequence when a single-stranded form of the first nucleic acid sequence can anneal to the second nucleic acid sequence under suitable annealing conditions (e.g., temperature, solution ionic strength). Hybridization and washing conditions are well known and exemplified in Sambrook J, Fritsch E F and Maniatis T, *Molecular Cloning: A Laboratory Manual*, 2nd ed., Cold Spring Harbor Laboratory: Cold Spring Harbor, N.Y. (1989), which is incorporated herein by reference, particularly Chapter 11 and Table 11.1

The term "DNA manipulation technique" refers to any technique in which the sequence of a DNA polynucleotide sequence is modified. Although the DNA polynucleotide sequence being modified can be used as a substrate itself for modification, it does not have to be physically in hand for certain techniques (e.g., a sequence stored in a computer can be used as the basis for the manipulation technique). A DNA manipulation technique can be used to delete and/or mutate one or more DNA sequences in a longer sequence. Examples of a DNA manipulation technique include recombinant DNA techniques (restriction and ligation, molecular cloning), polymerase chain reaction (PCR), and synthetic DNA methods (e.g., oligonucleotide synthesis and ligation). Regarding synthetic DNA techniques, a DNA manipulation technique can entail observing a DNA polynucleotide in silico, determining desired modifications (e.g., one or more deletions) of the DNA polynucleotide, and synthesizing a DNA polynucleotide that contains the desired modifications.

The term "in silico" herein means in or on an information storage and/or processing device such as a computer; done or produced using computer software or simulation, i.e., virtual reality.

The terms "cassette", "expression cassette", "gene cassette" and the like are used interchangeably herein. A cassette can refer to a promoter operably linked to a DNA sequence encoding a protein-coding RNA. A cassette may optionally be operably linked to a 3' non-coding sequence. The structure of a cassette herein can optionally be represented by the simple notation system of "X::Y::Z". Specifically, X describes a promoter, Y describes a coding sequence, and Z describes a terminator (optional); X is operably linked to Y, and Y is operably linked to Z.

The terms "upstream" and "downstream" as used herein with respect to polynucleotides refer to "5' of" and "3' of", respectively.

The term "expression" as used herein refers to (i) transcription of RNA (e.g., mRNA or a non-protein-coding RNA) from a coding region, and/or (ii) translation of a polypeptide from mRNA. Expression of a coding region of a polynucleotide sequence can be up-regulated or down-regulated in certain embodiments.

The term "operably linked" as used herein refers to the association of two or more nucleic acid sequences such that the function of one is affected by the other. For example, a promoter is operably linked with a coding sequence when it is capable of affecting the expression of that coding sequence. That is, the coding sequence is under the transcriptional control of the promoter. A coding sequence can be operably linked to one (e.g., promoter) or more (e.g., promoter and terminator) regulatory sequences, for example.

The term "recombinant" when used herein to characterize a DNA sequence such as a plasmid, vector, or construct refers to an artificial combination of two otherwise separated segments of sequence, e.g., by chemical synthesis and/or by manipulation of isolated segments of nucleic acids by genetic engineering techniques. Methods for preparing recombinant constructs/vectors herein can follow standard recombinant DNA and molecular cloning techniques as described by J. Sambrook and D. Russell (*Molecular Cloning: A Laboratory Manual,* 3rd Edition, Cold Spring Harbor Laboratory Press, Cold Spring Harbor, N.Y., 2001); T. J. Silhavy et al. (*Experiments with Gene Fusions,* Cold Spring Harbor Laboratory Press, Cold Spring Harbor, N.Y., 1984); and F. M. Ausubel et al. (*Short Protocols in Molecular Biology,* 5th Ed. Current Protocols, John Wiley and Sons, Inc., NY, 2002), for example.

The term "transformation" as used herein refers to the transfer of a nucleic acid molecule into a host organism or host cell by any method. A nucleic acid molecule that has been transformed into an organism/cell may be one that replicates autonomously in the organism/cell, or that integrates into the genome of the organism/cell, or that exists transiently in the cell without replicating or integrating. Non-limiting examples of nucleic acid molecules suitable for transformation are disclosed herein, such as plasmids and linear DNA molecules. Host organisms/cells herein containing a transforming nucleic acid sequence can be referred to as "transgenic", "recombinant", "transformed", "engineered", as a "transformant", and/or as being "modified for exogenous gene expression", for example.

The terms "sequence identity" or "identity" as used herein with respect to polynucleotide or polypeptide sequences refer to the nucleic acid bases or amino acid residues in two sequences that are the same when aligned for maximum correspondence over a specified comparison window. Thus, "percentage of sequence identity" or "percent identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. It would be understood that, when calculating sequence identity between a DNA sequence and an RNA sequence, T residues of the DNA sequence align with, and can be considered "identical" with, U residues of the RNA sequence. For purposes of determining "percent complementarity" of first and second polynucleotides, one can obtain this by determining (i) the percent identity between the first polynucleotide and the complement sequence of the second polynucleotide (or vice versa), for example, and/or (ii) the percentage of bases between the first and second polynucleotides that would create canonical Watson and Crick base pairs.

The Basic Local Alignment Search Tool (BLAST) algorithm, which is available online at the National Center for Biotechnology Information (NCBI) website, may be used, for example, to measure percent identity between or among two or more of the polynucleotide sequences (BLASTN algorithm) or polypeptide sequences (BLASTP algorithm) disclosed herein. Alternatively, percent identity between sequences may be performed using a Clustal algorithm (e.g., ClustalW, ClustalV, or Clustal-Omega). For multiple alignments using a Clustal method of alignment, the default values may correspond to GAP PENALTY=10 and GAP LENGTH PENALTY=10. Default parameters for pairwise alignments and calculation of percent identity of protein sequences using a Clustal method may be KTUPLE=1, GAP PENALTY=3, WINDOW=5 and DIAGONALS SAVED=5. For nucleic acids, these parameters may be KTUPLE=2, GAP PENALTY=5, WINDOW=4 and DIAGONALS SAVED=4. Alternatively still, percent identity between sequences may be performed using an EMBOSS algorithm (e.g., needle) with parameters such as GAP OPEN=10, GAP EXTEND=0.5, END GAP PENALTY=false, END GAP OPEN=10, END GAP EXTEND=0.5 using a BLOSUM matrix (e.g., BLOSUM62).

Various polypeptide amino acid sequences and polynucleotide sequences are disclosed herein as features of certain embodiments. Variants of these sequences that are at least about 70-85%, 85-90%, or 90%-95% identical to the sequences disclosed herein can be used or referenced. Alternatively, a variant amino acid sequence or polynucleotide sequence can have at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity with a sequence disclosed herein. The variant amino acid sequence or polynucleotide sequence has the same function/activity of the disclosed sequence, or at least about 80%, 81%, 82%, 83%, 84%, 85%, 86%, 87%, 88%, 89%, 90%, 91%, 92%, 93%, 94%, 95%, 96%, 97%, 98%, or 99% of the function/activity of the disclosed sequence. Any polypeptide amino acid sequence disclosed herein not beginning with a methionine can typically further comprise at least a start-methionine at the N-terminus of the amino acid sequence.

All the amino acid residues at each amino acid position of the proteins disclosed herein are examples. Given that certain amino acids share similar structural and/or charge features with each other (i.e., conserved), the amino acid at each position of a protein herein can be as provided in the disclosed sequences or substituted with a conserved amino acid residue ("conservative amino acid substitution") as follows:

1. The following small aliphatic, nonpolar or slightly polar residues can substitute for each other: Ala (A), Ser (S), Thr (T), Pro (P), Gly (G);
2. The following polar, negatively charged residues and their amides can substitute for each other: Asp (D), Asn (N), Glu (E), Gln (Q);
3. The following polar, positively charged residues can substitute for each other: His (H), Arg (R), Lys (K);

4. The following aliphatic, nonpolar residues can substitute for each other: Ala (A), Leu (L), Ile (I), Val (V), Cys (C), Met (M); and
5. The following large aromatic residues can substitute for each other: Phe (F), Tyr (Y), Trp (W).

The term "isolated" as used herein refers to a polynucleotide or polypeptide molecule that has been completely or partially purified from its native source. In some instances, the isolated polynucleotide or polypeptide molecule is part of a greater composition, buffer system or reagent mix. For example, the isolated polynucleotide or polypeptide molecule can be comprised within a cell or organism in a heterologous manner. "Isolated" herein can also characterize embodiments that are synthetic/man-made, and/or have properties that are not naturally occurring.

The term "increased" as used herein can refer to a quantity or activity that is at least about 1%, 2%, 3%, 4%, 5%, 6%, 7%, 8%, 9%, 10%, 11%, 12%, 13%, 14%, 15%, 16%, 17%, 18%, 19%, 20%, 50%, 100%, or 200% more than the quantity or activity for which the increased quantity or activity is being compared. The terms "increased", "elevated", "enhanced", "greater than", "improved" and the like are used interchangeably herein.

Some advances have been made in producing linear glucan polymers having a high percentage of alpha-1,3 glycosidic linkages suitable for use in spinning fibers. However, less attention appears to have been drawn to producing branched alpha-glucan polymers.

Thus, disclosed herein are glucosyltransferases that can synthesize branched alpha-glucan. Some embodiments disclosed herein concern a glucosyltransferase enzyme comprising a catalytic domain that comprises an amino acid sequence that is at least 90% identical to amino acid positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97, wherein the catalytic domain lacks at least one motif selected from the group consisting of:
(i) a motif comprising an amino acid sequence that is at least 90% identical to SEQ ID NO:78,
(ii) a motif comprising an amino acid sequence that is at least 90% identical to SEQ ID NO:79, and
(iii) a motif comprising an amino acid sequence that is at least 90% identical to SEQ ID NO:80;
and wherein the glucosyltransferase enzyme produces a branched alpha-glucan polymer.

A glucosyltransferase enzyme herein, since it lacks one or more of motifs (i), (ii), and/or (iii), can optionally be characterized as a modified glucosyltransferase enzyme. Such a modified glucosyltransferase produces branched alpha-glucan polymer by virtue of lacking one or more of the above motifs. In contrast, a glucosyltransferase that has a catalytic domain comprising an amino acid sequence of at least 90% identity to amino acid positions 54-957 of SEQ ID NO:65 and that has all three of the above motifs can produce poly alpha-1,3-glucan having at least 95% alpha-1,3-linkages (such a glucan polymer is mostly or completely linear). Note that each of the above portions of SEQ ID NOs:85, 87, 89, 91, 93, 95 and 97 can be derived from amino acid positions 54-957 of SEQ ID NO:65 (refer to Examples 6-11), but in a manner lacking motifs i, ii, and/or iii. For example, consider that:

residues 54-941 of SEQ ID NO:85 essentially represent positions 54-957 of SEQ ID NO:65, but in which motif (i) is lacking;

residues 54-927 of SEQ ID NO:87 essentially represent positions 54-957 of SEQ ID NO:65, but in which motif (ii) is lacking;

residues 54-935 of SEQ ID NO:89 essentially represent positions 54-957 of SEQ ID NO:65, but in which motif (iii) is lacking;

residues 54-911 of SEQ ID NO:91 essentially represent positions 54-957 of SEQ ID NO:65, but in which motifs (i) and (ii) are lacking;

residues 54-919 of SEQ ID NO:93 essentially represent positions 54-957 of SEQ ID NO:65, but in which motifs (i) and (iii) are lacking;

residues 54-905 of SEQ ID NO:95 essentially represent positions 54-957 of SEQ ID NO:65, but in which motifs (ii) and (iii) are lacking; and residues 54-889 of SEQ ID NO:97 essentially represent positions 54-957 of SEQ ID NO:65, but in which motif (i), (ii) and (iii) are lacking;

The catalytic domain of a glucosyltransferase as presently disclosed can comprise an amino acid sequence that is at least 90% identical to amino acid positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97. In certain embodiments, the amino acid sequence of a glucosyltransferase catalytic domain can be at least 91%, 92%, 93%, 94%, 95%, 96%, 97%, 98%, 98.5%, 99%, or 99.5% identical to amino acid positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97.

Amino acid positions 54-957 of SEQ ID NO:65 represent, approximately, a catalytic domain sequence of the glucosyltransferase identified in GENBANK under GI number 47527 (SEQ ID NO:60). SEQ ID NO:65 generally represents the catalytic domain and glucan-binding domain of SEQ ID NO:60; the signal peptide and variable domains are missing from SEQ ID NO:65. As shown in Example 14, a catalytic domain sequence of SEQ ID NO:65 (residues 54-957) was able to catalyze the production of an alpha-glucan. Example 14 also shows that a catalytic domain sequence of SEQ ID NO:14 (residues 57-906 of SEQ ID NO:14 [GTF 5926]) was able to catalyze production of an alpha-glucan. The molecular weight of the alpha-glucan produced by each of these catalytic domain sequences generally corresponded with the molecular weight of the product produced by their enzyme counterparts containing both the catalytic domain and glucan binding domain (refer to activity of SEQ ID NOs:65 and 14 in Table 4, $DP_w$150). Thus, it is believed that a catalytic domain sequence herein is an important structural component for a glucosyltransferase enzyme to be capable of producing alpha-glucan polymer.

Although it is believed that a glucosyltransferase enzyme herein need only have a catalytic domain sequence comprising an amino acid sequence that is at least 90% identical to amino acid positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97 (and lacking motif i, ii, and/or iii), the glucosyltransferase enzyme can be comprised within a larger amino acid sequence. For example, the catalytic domain may be linked at its C-terminus to a glucan-binding domain, and/or linked at its N-terminus to a variable domain and/or signal peptide. Examples of glucosyltransferase enzymes herein comprising catalytic and glucan-binding domains can comprise SEQ ID NO:85, 87, 89, 91, 93, 95, or 97, or an amino acid sequence that is at least 90%, 91%, 92%, 93%, 94%, 95%, 96%, 97%, 98%, 98.5%, 99%, or 99.5% identical to any of these sequences (and lacking motif i, ii, and/or iii).

Still further examples of glucosyltransferase enzymes can be any as disclosed herein and that include 1-300 (or any integer there between [e.g., 10, 15, 20, 25, 30, 35, 40, 45, or 50]) residues on the N-terminus and/or C-terminus. Such additional residues may be from a corresponding wild type sequence from which the glucosyltransferase enzyme is derived, or may be a heterologous sequence such as an epitope tag (at either N- or C-terminus) or a heterologous signal peptide (at N-terminus), for example. Examples include glucosyltransferase enzymes comprising an amino acid sequence that is at least 90%, 91%, 92%, 93%, 94%, 95%, 96%, 97%, 98%, 98.5%, 99%, or 99.5% identical to SEQ ID NO:65, 30, 4, 28, or 20, and that lack motif i, ii, and/or iii. These sequences (SEQ ID NO:65, 30, 4, 28, 20) lack an N-terminal signal peptide (as well as a variable domain) (refer to Table 1). Still other examples include glucosyltransferase enzymes that (i) comprise an amino acid sequence that is at least 90%, 91%, 92%, 93%, 94%, 95%, 96%, 97%, 98%, 98.5%, 99%, or 99.5% A identical to SEQ ID NO:60, 61, 62, 63, or 64, and (i) lack motif i, ii, and/or iii.

An N-terminal start-methionine (amino acid position 1) has been added to certain sequences herein for intracellular expression purposes (expressed enzyme can be obtained in a cell lysate, for example) (e.g., SEQ ID NOs:85, 87, 89, 91, 93, 95, 97, 65, 30, 4, 28, 20). One of skill in the art would understand that an intervening heterologous amino acid sequence such as an epitope and/or signal peptide could optionally be added between the start methionine and glucosyltransferase sequence. Thus, for example, a glucosyltransferase enzyme herein may comprise an amino acid sequence that (i) is at least 90%, 91%, 92%, 93%, 94%, 95%, 96%, 97%, 98%, 98.5%, 99%, or 99.5% identical to the amino acid sequence beginning at position 2 of a disclosed amino acid sequence, and (ii) lacks motif i, ii, and/or iii.

A glucosyltransferase enzyme herein typically lacks an N-terminal signal peptide. An expression system for producing a glucosyltransferase enzyme herein may employ an enzyme-encoding polynucleotide that further comprises sequence encoding an N-terminal signal peptide to direct extra-cellular secretion, if desired. The signal peptide in such embodiments is cleaved from the enzyme during the secretion process. The signal peptide may either be native or heterologous to the glucosyltransferase. An example of a signal peptide useful herein is one from a bacterial (e.g., a *Bacillus* species such as *B. subtilis*) or fungal species. An example of a bacterial signal peptide is an aprE signal peptide, such as one from *Bacillus* (e.g., *B. subtilis*, see Vogtentanz et al., *Protein Expr. Purif.* 55:40-52, which is incorporated herein by reference).

FIGS. 2A-O show that a catalytic domain sequence of GTF 7527 (residues 54-957 of SEQ ID NO:65) aligns with catalytic domain sequences of several other glucosyltransferase enzymes, with several regions showing complete conservation across all the sequences (residues with dark background). The dark background residues in FIGS. 2A-O visually map out the catalytic domain of each sequence, indicating their length to be about 850 to 900 amino acid residues long. Thus, the catalytic domain of a glucosyltransferase enzyme herein can be about 790 to 840, 850 to 900, or 790 to 900 (or any integer between 790 and 900) amino acid residues long (some of these numbers take into account embodiments in which motifs i, iii, and/or iii are removed), for example.

Certain of the conserved regions in FIGS. 2A-O include catalytic active site motifs SEQ ID NOs:68, 69, 70, and 71 (refer to Example 3). Thus, a catalytic domain sequence of a glucosyltransferase enzyme in some aspects can contain one or more of SEQ ID NOs:68, 69, 70, and 71 in alignment, respectively, with SEQ ID NOs:68, 69, 70, and 71 as present in amino acids 54-957 of SEQ ID NO:65. Other conserved regions in FIGS. 2A-O include SEQ ID NOs:72, 73, 74, 75, 76 and 77 (refer to Example 4). Thus, a catalytic domain sequence of a glucosyltransferase enzyme in some aspects can contain one or more of SEQ ID NOs:72, 73, 74, 75, 76 and 77 in alignment, respectively, with SEQ ID NOs:72, 73, 74, 75, 76 and 77 as present in amino acids 54-957 of SEQ ID NO:65.

The catalytic domain of a glucosyltransferase enzyme herein can have activity as exhibited by a catalytic domain of a glucosyltransferase classified under the glycoside hydrolase family 70 (GH70). Such a GH70 glucosyltransferase may be found in the CAZy (Carbohydrate-Active EnZymes) database (Cantarel et al., *Nucleic Acids Res.* 37:D233-238, 2009), for example.

A glucosyltransferase enzyme herein lacks at least one of motifs (i), (ii), or (iii). Motif (i) corresponds with "Motif 1a" (FIG. 3). Motif (ii) corresponds with "Motif 2" (FIG. 5). Motif (iii) corresponds with "Motif 3a" (FIG. 7). A glucosyltransferase can "lack" one or more of these motifs by virtue of a deletion and/or mutation (e.g., amino acid substitution), for example. In some embodiments, a glucosyltransferase can be characterized as lacking one of these motifs if no amino acid sequence within a catalytic domain sequence can be identified to have 90% or more identity to SEQ ID NO:78 (motif i), SEQ ID NO:79 (motif ii), or SEQ ID NO:78 (motif iii).

In certain embodiments, motif (i) can be at least 90%, 91%, 92%, 93%, 94%, 95%, 96%, 97%, 98%, 99%, or 100% identical to SEQ ID NO:78. In certain embodiments, motif (ii) can be at least 90%, 91%, 92%, 93%, 94%, 95%, 96%, 97%, 98%, 99%, or 100% identical to SEQ ID NO:79. In certain embodiments, motif (iii) can be at least 90%, 91%, 92%, 93%, 94%, 95%, 96%, 97%, 98%, 99%, or 100% identical to SEQ ID NO:80. Thus, it can be seen that in some aspects, motif (i) can comprise SEQ ID NO:78, motif (ii) can comprise SEQ ID NO:79, and motif (iii) can comprise SEQ ID NO:80.

Regarding motif (i) in certain embodiments, the first residue of SEQ ID NO:78 (D/N-K-S-I/N-L-D-E-Q-S-D-P-N-H) can be an aspartate (D) and the fourth residue can be an isoleucine (I). Alternatively, the first residue can be an aspartate (D) and the fourth residue can be a valine (V), or the first residue can be an asparagine (N) and the fourth residue can be an isoleucine (I), or the first residue can be an asparagine (N) and the fourth residue can be a valine (V).

Regarding motif (ii) in certain embodiments, the sixth residue of SEQ ID NO:79 (N-K-D-G-S-K/T-A-Y-N-E-D-G-T-V/A-K-Q/K-S-T-I-G-K-Y-N-E-K-Y-G-D-A-S) can be a lysine (K), the fourteenth residue can be a valine (V), and the sixteenth residue can be a glutamine (Q). Alternatively, the sixth residue can be a lysine (K), the fourteenth residue can be an alanine (A), and the sixteenth residue can be a glutamine (Q); or the sixth residue can be a lysine (K), the fourteenth residue can be an valine (V), and the sixteenth residue can be a lysine (K). Additional examples include where the sixth residue can be a threonine (T).

Regarding motif (iii) in certain embodiments, the ninth residue of SEQ ID NO:80 (L-P-T-D-G-K-M-D-N/K-S-D-V-E-L-Y-R-T-N/S-E) can be an asparagine (N) and the eighteenth residue can be an asparagine (N). Alternatively, the ninth residue can be an asparagine (N) and the eighteenth residue can be a serine (S), or the ninth residue can be a lysine (K) and the eighteenth residue can be an asparagine (N), or the ninth residue can be a lysine (K) and the eighteenth residue can be a serine (S).

A glucosyltransferase enzyme as presently disclosed may lack motif (i) only; motif (ii) only; motif (iii) only; both motifs (i) and (ii); both motifs (i) and (iii); both motifs (ii) and (iii); and all three of motifs (i), (ii) and (iii), for example.

The relative positions of motif (i) (SEQ ID NO:78), motif (ii) (SEQ ID NO:79) and motif (iii) (SEQ ID NO:80) align with residues 231-243, 396-425 and 549-567, respectively, of the GTF 7527 sequence (SEQ ID NO:65) shown in FIGS. 2A-O. In certain embodiments herein,
 (A) the position of the amino acid sequence that is at least 90% identical to SEQ ID NO:78 in the glucosyltransferase catalytic domain aligns with amino acid positions 231-243 of SEQ ID NO:65;
 (B) the position of the amino acid sequence that is at least 90% identical to SEQ ID NO:79 in the glucosyltransferase catalytic domain aligns with amino acid positions 396-425 of SEQ ID NO:65; and/or
 (C) the position of the amino acid sequence that is at least 90% identical to SEQ ID NO:80 in the glucosyltransferase catalytic domain aligns with amino acid positions 549-567 of SEQ ID NO:65.

The term "aligns with" can be used interchangeably with "corresponds to", "corresponds with", and the like. The relative positions of motifs (i), (ii) and/or (iii) in a glucosyltransferase catalytic domain can thus be determined with reference to the above amino acid positions in SEQ ID NO:65. For example, the sequence of a glucosyltransferase catalytic domain can be aligned with SEQ ID NO:65 using any means known in the art, such as through use of an alignment algorithm or software as described above (e.g., BLASTP, ClustalW, ClustalV, EMBOSS).

The relative positions of motifs (i), (ii) and/or (iii) in a glucosyltransferase catalytic domain can be determined with reference to certain conserved sequences, namely SEQ ID NOs:72, 73, 74, 75, 76 and 77, if desired.

Motif 1a (SEQ ID NO:78) is flanked by upstream and downstream conserved sequences as shown in FIG. 3. Preceding Motif 1a is the sequence SxxRxxN (SEQ ID NO:72), and following this motif is the sequence GGxxx-LLxNDxDxSNPxVQAExLN (SEQ ID NO:73). Thus, the position of motif (i) can be located between SEQ ID NOs:72 and 73. SEQ ID NO:72 can be directly adjacent (upstream) to motif (i), or 1, 2, 3, 4, 5, 6, 7, 8, 9, 10, 11, 12, 13, 14, or 15 (or 1-15) amino acid residues upstream motif (i). SEQ ID NO:73 can be directly adjacent (downstream) to motif (i), or 1, 2, 3, 4, or 5 (or 1-5) amino acid residues downstream motif (i).

Motif 2 (SEQ ID NO:79) is flanked by upstream and downstream conserved sequences as shown in FIG. 5. Specifically, preceding Motif 2 is the sequence WxxxDxxY (SEQ ID NO:74), and following this motif is the sequence YxFxRAHD (SEQ ID NO:75). Thus, the position of motif (ii) can be located between SEQ ID NOs:74 and 75. SEQ ID NO:74 can be directly adjacent (upstream) to motif (ii), or 1-65 (or any integer between 1 and 65) amino acid residues upstream motif (ii). SEQ ID NO:75 can be directly adjacent (downstream) to motif (ii), or 1, 2, 3, 4, or 5 (or 1-5) amino acid residues downstream motif (ii).

Motif 3a (SEQ ID NO:80) is flanked by upstream and downstream conserved sequences as shown in FIG. 7. Specifically, preceding Motif 3a is the sequence YxxGGQ (SEQ ID NO:76), and following this motif is the sequence VRxG (SEQ ID NO:77). Thus, the position of motif (iii) can be located between SEQ ID NOs:76 and 77. SEQ ID NO:76 can be directly adjacent (upstream) to motif (iii), or 1, 2, 3, 4, 5, 6, 7, 8, 9, 10, or 11 (or 1-11) amino acid residues upstream motif (iii). SEQ ID NO:77 can be directly adjacent (downstream) to motif (iii), or 1, 2, 3, 4, 5, 6, 7, 8, or 9 (or 1-9) amino acid residues downstream motif (iii).

Certain amino acid positions in the upstream/downstream conserved sequences SEQ ID NOs:72-77 can be any amino acid (indicated by an "x" in each sequence in Table 1). Examples of SEQ ID NOs:72 and 73 are as shown in any of the GTF sequences in FIGS. 2 and 3 at the amino acids of each GTF sequence aligning with positions 214-220 and 245-268, respectively, of SEQ ID NO:65 (GTF 7527). Examples of SEQ ID NOs:74 and 75 are as shown in any of the GTF sequences in FIGS. 2 and 5 at the amino acids of each GTF sequence aligning with positions 334-341 and 428-435, respectively, of SEQ ID NO:65 (GTF 7527). Examples of SEQ ID NOs:76 and 77 are as shown in any of the GTF sequences in FIGS. 2 and 7 at the amino acids of each GTF sequence aligning with positions 537-542 and 572-575, respectively, of SEQ ID NO:65 (GTF 7527).

The foregoing location information (e.g., alignment coordinates and/or location between certain conserved sequences) can be used, for instance, in an effort to determine whether a glucosyltransferase lacks at least one of motifs (i), (ii), or (iii).

A glucosyltransferase enzyme herein lacking at least one of motifs (i), (ii), or (iii) can produce a branched alpha-glucan polymer. In some embodiments, alpha-glucan polymer branching can be gauged using measurements of intrinsic viscosity and/or branching index (g'), which can be measured following any means known in the art. For example, it is believed that Weaver et al. (*J. Appl. Polym. Sci.* 35:1631-1637) and Chun and Park (*Macromol. Chem. Phys.* 195:701-711) describe suitable techniques of measuring intrinsic viscosity, and Zdunek et al. (*Food Bioprocess Technol.* 7:3525-3535) and Herget et al. (*BMC Struct. Biol.* 8:35) describe suitable techniques for measuring branching index. All these references are incorporated herein by reference. Also, the methodology provided in the below Examples can be used, for example.

Alpha-glucan polymer branching herein can, in some aspects, be judged with respect to measurements made against poly alpha-1,3-glucan containing at least 95%, 96%, 97%, 98%, or 99% alpha-1,3 glycosidic linkages (such polymer is expected to be mostly unbranched), or 100% alpha-1,3 glycosidic linkages (such polymer is linear/unbranched). Measurements can be with respect to intrinsic viscosity and/or branching index, for example. In certain embodiments, alpha-glucan produced by a glucosyltransferase herein can have an intrinsic viscosity and/or branching index (each measurement per methodology disclosed in below Examples, for example) that is reduced by at least about 30%, 40%, 50%, 60%, 70%, 80%, or 90% compared to poly alpha-1,3-glucan that is completely or mostly unbranched.

A branched alpha-glucan polymer herein is believed to contain at least both alpha-1,3 and alpha-1,6 glycosidic linkages, for example. A branched alpha-glucan polymer may possibly further comprise alpha-1,2 and/or alpha-1,4 glycosidic linkages in some aspects. There are likely no beta-glycosidic linkages present. In certain embodiments, branched alpha-glucan polymer can have less than 95%, 94%, 93%, 92%, 91%, 90%, 85%, 80%, 75%, 70%, 65%, 60%, 55%, 50%, 45%, 40%, 35%, or 30% alpha-1,3 glycosidic linkages. A branched alpha-glucan polymer can have at least 5%, 10%, 15%, 20%, 25%, 30%, 35%, 40%, 45%, 50%, 55%, 60%, 65%, or 70% alpha-1,6-glycosidic linkages in some aspects. It is contemplated that, in some aspects, a branch point occurs on average every (or at least every) 5, 10, 15, 20, 25, 30, 35, or 40 monosaccharide units in a branched alpha-glucan herein.

The glycosidic linkage profile of a glucan polymer herein can be determined using any method known in the art. For example, the linkage profile can be determined using methods that use nuclear magnetic resonance (NMR) spectroscopy (e.g., $^{13}$C NMR or $^{1}$H NMR). These and other methods that can be used are disclosed in *Food Carbohydrates: Chemistry, Physical Properties, and Applications* (S. W. Cui, Ed., Chapter 3, S. W. Cui, Structural Analysis of Polysaccharides, Taylor & Francis Group LLC, Boca Raton, Fla., 2005), which is incorporated herein by reference.

A branched alpha-glucan polymer in most embodiments is insoluble. Such insolubility is observed in aqueous conditions (e.g., solvent comprising at least 90% water) of generally neutral pH (e.g., between 6-8), for example.

A glucosyltransferase enzyme herein can be derived from any microbial source, such as a bacteria or fungus. Examples of bacterial glucosyltransferase enzymes are those derived from a *Streptococcus* species, *Leuconostoc* species or *Lactobacillus* species. Examples of *Streptococcus* species include *S. salivarius, S. sobrinus, S. dentirousetti, S. downei, S. mutans, S. oralis, S. gallolyticus* and *S. sanguinis*. Examples of *Leuconostoc* species include *L. mesenteroides, L. amelibiosum, L. argentinum, L. carnosum, L. citreum, L. cremoris, L. dextranicum* and *L. fructosum*. Examples of *Lactobacillus* species include *L. acidophilus, L. delbrueckii, L. helveticus, L. salivarius, L. casei, L. curvatus, L. plantarum, L. sakei, L. brevis, L. buchneri, L. fermentum* and *L. reuteri*.

A glucosyltransferase enzyme herein can be produced by any means known in the art. For example, a glucosyltransferase enzyme may be produced recombinantly in a heterologous expression system, such as a microbial heterologous expression system. Examples of heterologous expression systems include bacterial (e.g., *E. coli* such as TOP10 or MG1655; *Bacillus* sp.) and eukaryotic (e.g., yeasts such as *Pichia* sp. and *Saccharomyces* sp.) expression systems.

In certain embodiments, a heterologous gene expression system may be one that is designed for protein secretion. A glucosyltransferase enzyme typically comprises a signal peptide (signal sequence) in such embodiments. The signal peptide may be either its native signal peptide or a heterologous signal peptide.

A glucosyltransferase enzyme described herein may be used in any purification state (e.g., pure or non-pure). For example, a glucosyltransferase enzyme may be purified and/or isolated prior to its use. Examples of glucosyltransferase enzymes that are non-pure include those in the form of a cell lysate. A cell lysate or extract may be prepared from a bacteria (e.g., *E. coli*) used to heterologously express the enzyme. For example, the bacteria may be subjected to disruption using a French pressure cell. In alternative embodiments, bacteria may be homogenized with a homogenizer (e.g., APV, Rannie, Gaulin). A glucosyltransferase enzyme is typically soluble in these types of preparations. A bacterial cell lysate, extract, or homogenate herein may be used at about 0.15-0.3% (v/v), for example, in a reaction solution for producing branched alpha-glucan.

The activity of a glucosyltransferase enzyme herein can be determined using any method known in the art. For example, glucosyltransferase enzyme activity can be determined by measuring the production of reducing sugars (fructose and glucose) in a reaction solution containing sucrose (50 g/L), dextran T10 (1 mg/mL) and potassium phosphate buffer (pH 6.5, 50 mM), where the solution is held at 22-25° C. for 24-30 hours. The reducing sugars can be measured, for instance, by adding 0.01 mL of the reaction solution to a mixture containing 1 N NaOH and 0.1% triphenyltetrazolium chloride and then monitoring the increase in absorbance at $OD_{480nm}$ for five minutes.

Some embodiments disclosed herein concern a polynucleotide comprising a nucleotide sequence that encodes a glucosyltransferase as presently disclosed (e.g., a GTF comprising a catalytic domain with an amino acid sequence that [i] is at least 90% identical to positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97, and [ii] lacks at least one of motifs i, ii, or iii). Optionally, one or more regulatory sequences are operably linked to the nucleotide sequence, and preferably a promoter sequence is included as a regulatory sequence.

A polynucleotide comprising a nucleotide sequence encoding a glucosyltransferase herein can be a vector or construct useful for transferring a nucleotide sequence into a cell, for example. Examples of a suitable vector/construct can be selected from a plasmid, yeast artificial chromosome (YAC), cosmid, phagemid, bacterial artificial chromosome (BAC), virus, or linear DNA (e.g., linear PCR product). A polynucleotide sequence in some aspects can be capable of existing transiently (i.e., not integrated into the genome) or stably (i.e., integrated into the genome) in a cell. A polynucleotide sequence in some aspects can comprise, or lack, one or more suitable marker sequences (e.g., selection or phenotype marker).

A polynucleotide sequence in certain embodiments can comprise one or more regulatory sequences operably linked to the nucleotide sequence encoding a glucosyltransferase. For example, a nucleotide sequence encoding a glucosyltransferase may be in operable linkage with a promoter sequence (e.g., a heterologous promoter). A promoter sequence can be suitable for expression in a cell (e.g., bacterial cell such as *E. coli*; eukaryotic cell such as a fungus, yeast, insect, or mammalian cell) or in an in vitro protein expression system, for example. Examples of other suitable regulatory sequences are disclosed herein (e.g., transcription terminator sequences).

In some embodiments, a polynucleotide sequence does not comprise a regulatory sequence operably linked to a nucleotide encoding a glucosyltransferase. Such a polynucleotide could be a cloning vector (e.g., cloning plasmid), for example, used simply for sub-cloning or gene shuttling purposes.

A promoter sequence herein can be constitutive or inducible, for example. A promoter in certain aspects can comprise a strong promoter, which is a promoter that can direct a relatively large number of productive initiations per unit time, and/or is a promoter driving a higher transcription level than the average transcription level of the genes in a cell comprising the strong promoter. Examples of strong promoters useful herein include some bacterial and phage promoters that are well known in the art, and some yeast promoters (e.g., Velculescu et al., *Cell* 88:243-251, incorporated herein by reference).

The present disclosure also concerns a method of preparing a polynucleotide sequence encoding a glucosyltransferase enzyme that produces a branched alpha-glucan polymer. This method comprises:

(a) identifying a polynucleotide sequence encoding a parent glucosyltransferase enzyme that comprises a catalytic domain comprising:
  (1) an amino acid sequence that is at least 90% identical to amino acid positions 54-957 of SEQ ID NO:65, and
  (2) the following three motifs:
    (i) a motif comprising an amino acid sequence that is at least 90% identical to SEQ ID NO:78,
    (ii) a motif comprising an amino acid sequence that is at least 90% identical to SEQ ID NO:79, and
    (iii) a motif comprising an amino acid sequence that is at least 90% identical to SEQ ID NO:80;
and
(b) modifying the polynucleotide sequence identified in step (a) to delete and/or mutate at least one of motifs (i), (ii), or (iii) encoded by the polynucleotide sequence, thereby providing a polynucleotide sequence encoding a glucosyltransferase enzyme that produces a branched alpha-glucan polymer. Examples of a polynucleotide sequence produced by such a method are disclosed in the above embodiments concerning a polynucleotide sequence. The glucosyltransferase encoded by the polynucleotide sequence produced in step (b) can be characterized as a child glucosyltransferase, if desired.

Identification step (a) herein can, in some instances, comprise identifying an amino acid sequence of a parent glucosyltransferase enzyme. A polynucleotide sequence could be determined from this amino acid sequence according to the genetic code (codons), such as the genetic code used in the species from which the parent glucosyltransferase was identified.

The presence of motifs (i), (ii), and (iii) in the catalytic domain of a parent glucosyltransferase enzyme can be detected following any means known in the art and/or any procedure described herein. For example, detection can be performed (a) in silico, (b) with a method comprising a nucleic acid hybridization step, (c) with a method comprising a protein sequencing step, and/or (d) with a method comprising a protein binding step.

Motifs (i), (ii) and (iii) were identified by in silico detection (see Example 4 below). Thus, the amino acid sequences of parent glucosyltransferase enzymes (and/or nucleotide sequences encoding such glucosyltransferase enzymes) stored in a computer or database (e.g., public databases such as GENBANK, EMBL, REFSEQ, GENEPEPT, SWISS-PROT, PIR, PDB) can be reviewed in silico to identify a glucosyltransferase enzyme comprising motifs (i), (ii) and (iii) in its catalytic domain, for example. Such review could comprise using any means known in the art such as through use of an alignment algorithm or software as described above (e.g., BLASTN, BLASTP, ClustalW, ClustalV, EMBOSS). The sequence of the glucosyltransferase catalytic domain being reviewed could be aligned with a catalytic domain sequence of SEQ ID NO:65 (GTF 7527), which comprises Motifs 1a (SEQ ID NO:78), 2 (SEQ ID NO:79) and 3a (SEQ ID NO:80), to detect the presence or absence of motifs (i), (ii), and/or (iii). Alternatively, the sequence of the glucosyltransferase catalytic domain being reviewed could be aligned with a catalytic domain sequence of SEQ ID NO:30 (GTF 2678), SEQ ID NO:4 (GTF 6855), SEQ ID NO:28 (GTF 2919), and/or SEQ ID NO:20 (GTF 2765), all of which comprise Motifs 1a (SEQ ID NO:78), 2 (SEQ ID NO:79) and 3a (SEQ ID NO:80), to identify the presence or absence of motifs (i), (ii), and/or (iii).

Another in silico means for detecting motifs (i), (ii), and (iii) in a glucosyltransferase catalytic domain sequence can comprise comparing the predicted three-dimensional structure (tertiary structure) of a glucosyltransferase catalytic domain sequence with a reference structure. The structures of both the catalytic domain being reviewed and the reference can be visually compared using any means known in the art such as with a computer program that provides a structure based on amino acid sequence input (e.g., software package MOE, Chemical Computing Group, Montreal, Canada). For example, if the reference structure lacks motif (i), (ii), and/or (iii), the comparison may detect the presence of motif (i), (ii), and/or (iii) by showing a domain(s) in the structure being reviewed that does not have a corresponding domain in the reference structure. Examples of this type of comparison are shown in FIGS. 4a, 4b, 6a, 6b, 8a and 8b.

Alternatively, identifying a parent glucosyltransferase enzyme having motifs (i), (ii), and (iii) in its catalytic domain can be performed via a method comprising a nucleic acid hybridization step. Such a method can comprise using DNA hybridization (e.g., Southern blot, dot blot), RNA hybridization (e.g., northern blot), or any other method that has a nucleic acid hybridization step (e.g., DNA sequencing, PCR, RT-PCR, all of which may comprise hybridization of an oligonucleotide), for example. As an example, an oligonucleotide that would hybridize to a nucleotide sequence encoding Motif 1a (SEQ ID NO:78), 2 (SEQ ID NO:79), or 3a (SEQ ID NO:80) could be used to detect its presence or absence in a polynucleotide sequence encoding the glucosyltransferase catalytic domain being reviewed. Conditions and parameters for carrying out hybridization methods in general are well known and disclosed, for example, in Sambrook J, Fritsch E F and Maniatis T, *Molecular Cloning: A Laboratory Manual*, Cold Spring Harbor Laboratory: Cold Spring Harbor, N.Y. (1989); Silhavy T J, Bennan M L and Enquist L W, *Experiments with Gene Fusions*, Cold Spring Harbor Laboratory: Cold Spring Harbor, N.Y. (1984); Ausubel F M et al., *Current Protocols in Molecular Biology*, published by Greene Publishing Assoc. and Wiley-Interscience, Hoboken, N.J. (1987); and Innis M A, Gelfand D H, Sninsky J J and White T J (Editors), *PCR Protocols: A Guide to Methods and Applications*, Academic Press, Inc., San Diego, Calif. (1990).

In another aspect, a parent glucosyltransferase enzyme comprising motifs (i), (ii), and (iii) in its catalytic domain can be detected using a method comprising a protein sequencing step. Such a protein sequencing step can comprise one or more procedures such as N-terminal amino acid analysis, C-terminal amino acid analysis, Edman degradation, or mass spectrometry, for example.

In still another aspect, a parent glucosyltransferase enzyme comprising motifs (i), (ii), and (iii) in its catalytic domain can be detected using a method comprising a protein binding step. Such a protein binding step could be performed using an antibody that specifically binds to one of these motifs, for example. Antibodies for identifying the presence or absence of motif (i) can be specific for an amino acid sequence that is at least 90% identical to SEQ ID NO:78. Antibodies for identifying the presence or absence of motif (ii) can be specific for an amino acid sequence that is at least 90% identical to SEQ ID NO:79. Antibodies for identifying the presence or absence of motif (iii) can be specific for an amino acid sequence that is at least 90% identical to SEQ ID NO:80.

A parent glucosyltransferase in a polynucleotide preparation method herein comprises a catalytic domain comprising motifs (i), (ii) and (iii). Motif (i) can be at least 90%, 91%, 92%, 93%, 94%, 95%, 96%, 97%, 98%, 99%, or 100% identical to SEQ ID NO:78. Motif (ii) can be at least 90%, 91%, 92%, 93%, 94%, 95%, 96%, 97%, 98%, 99%, or 100% identical to SEQ ID NO:79. Motif (iii) can be at least 90%, 91%, 92%, 93%, 94%, 95%, 96%, 97%, 98%, 99%, or 100% identical to SEQ ID NO:80. Thus, it can be seen that in certain embodiments of an identification method herein, motif (i) can comprise SEQ ID NO:78, motif (ii) can comprise SEQ ID NO:79, and motif (iii) can comprise SEQ ID NO:80.

Regarding motif (i) in certain embodiments, the first residue of SEQ ID NO:78 (D/N-K-S-IN-L-D-E-Q-S-D-P-N-H) can be an aspartate (D) and the fourth residue can be an isoleucine (I). Alternatively, the first residue can be an aspartate (D) and the fourth residue can be a valine (V), or the first residue can be an asparagine (N) and the fourth residue can be an isoleucine (I), or the first residue can be an asparagine (N) and the fourth residue can be a valine (V).

Regarding motif (ii) in certain embodiments, the sixth residue of SEQ ID NO:79 (N-K-D-G-S-K/T-A-Y-N-E-D-G-T-V/A-K-Q/K-S-T-I-G-K-Y-N-E-K-Y-G-D-A-S) can be a lysine (K), the fourteenth residue can be a valine (V), and the sixteenth residue can be a glutamine (Q). Alternatively, the sixth residue can be a lysine (K), the fourteenth residue can be an alanine (A), and the sixteenth residue can be a glutamine (Q); or the sixth residue can be a lysine (K), the fourteenth residue can be an valine (V), and the sixteenth residue can be a lysine (K). Additional examples include where the sixth residue can be a threonine (T).

Regarding motif (iii) in certain embodiments, the ninth residue of SEQ ID NO:80 (L-P-T-D-G-K-M-D-N/K-S-D-V-E-L-Y-R-T-N/S-E) can be an asparagine (N) and the eighteenth residue can be an asparagine (N). Alternatively, the ninth residue can be an asparagine (N) and the eighteenth residue can be a serine (S), or the ninth residue can be a lysine (K) and the eighteenth residue can be an asparagine (N), or the ninth residue can be a lysine (K) and the eighteenth residue can be a serine (S).

Any of the above features regarding the location of motifs (i), (ii) and (iii) in a glucosyltransferase enzyme catalytic domain sequence can be used appropriately to detect one or more of these motifs in a parent glucosyltransferase. The relative positions of motifs (i) (SEQ ID NO:78), (ii) (SEQ ID NO:79) and (iii) (SEQ ID NO:80) align with residues 231-243, 396-425 and 549-567, respectively, of the GTF 7527 sequence (SEQ ID NO:65) shown in FIGS. 2A-O. In certain embodiments herein, (A) the position of the amino acid sequence that is at least 90% identical to SEQ ID NO:78 in the glucosyltransferase catalytic domain aligns with amino acid positions 231-243 of SEQ ID NO:65;

(B) the position of the amino acid sequence that is at least 90% identical to SEQ ID NO:79 in the glucosyltransferase catalytic domain aligns with amino acid positions 396-425 of SEQ ID NO:65; and/or (C) the position of the amino acid sequence that is at least 90% identical to SEQ ID NO:80 in the glucosyltransferase catalytic domain aligns with amino acid positions 549-567 of SEQ ID NO:65.

The relative position(s) of the amino acid sequence(s) detected in the parent glucosyltransferase catalytic domain can thus be determined with reference to the above amino acid positions in SEQ ID NO:65. For example, the sequence of a putative parent glucosyltransferase catalytic domain can be aligned with SEQ ID NO:65 using any means known in the art and/or as described above.

Alternatively, motif (i), (ii), and/or (iii) can be detected based on proximity to certain conserved sequences, namely SEQ ID NOs:72, 73, 74, 75, 76 and 77, as described above.

In some embodiments, it is contemplated that detecting any one of motifs (i), (ii), or (iii) effectively results in identification of a parent glucosyltransferase catalytic domain having all three of these motifs. This being said, identifying a parent glucosyltransferase herein can optionally comprise detecting one of, two of, or all three, of motifs (i), (ii) and/or (iii) in a glucosyltransferase catalytic domain.

A parent glucosyltransferase in a polynucleotide preparation method herein can comprise a catalytic domain comprising an amino acid sequence that is at least 90% identical to amino acid positions 54-957 of SEQ ID NO:65. Alternatively, a parent glucosyltransferase herein can comprise a catalytic domain having an amino acid sequence that is at least 90% identical to amino acid positions 55-960 of SEQ ID NO:30, positions 55-960 of SEQ ID NO:4, positions 55-960 of SEQ ID NO:28, and/or positions 55-960 of SEQ ID NO:20. Alternatively still, a parent glucosyltransferase catalytic domain can be detected that comprises an amino acid sequence that is 100% identical to, or at least 91%, 92%, 93%, 94%, 95%, 96%, 97%, 98%, 98.5%, 99%, or 99.5% identical to, any of the foregoing sequences.

Certain of the conserved regions in FIGS. 2A-O include catalytic active site motifs SEQ ID NOs:68, 69, 70, and 71 (refer to Example 3). Thus, a catalytic domain sequence of a parent glucosyltransferase enzyme in some aspects can be identified based on having one or more of SEQ ID NOs:68, 69, 70, and 71 in alignment, respectively, with SEQ ID NOs:68, 69, 70, and 71 as present in amino acids 54-957 of SEQ ID NO:65. Other conserved regions in FIGS. 2A-O include SEQ ID NOs:72, 73, 74, 75, 76 and 77 (refer to Example 4). Thus, a catalytic domain sequence of a parent glucosyltransferase enzyme in some aspects can be identified based on having one or more of SEQ ID NOs:72, 73, 74, 75, 76 and 77 in alignment, respectively, with SEQ ID NOs:72, 73, 74, 75, 76 and 77 as present in amino acids 54-957 of SEQ ID NO:65.

Although it is believed that a glucosyltransferase enzyme herein need only have a catalytic domain sequence comprising an amino acid sequence that is at least 90% identical to amino acid positions 54-957 of SEQ ID NO:65 (or positions 55-960 of SEQ ID NO:30, positions 55-960 of SEQ ID NO:4, positions 55-960 of SEQ ID NO:28, or positions 55-960 of SEQ ID NO:20), a parent glucosyltransferase enzyme identified in a polynucleotide preparation method herein is typically comprised within a larger amino acid sequence. For example, the catalytic domain may be linked at its C-terminus to a glucan-binding domain, and/or linked at its N-terminus to a variable domain and/or signal peptide.

The catalytic domain of a parent glucosyltransferase enzyme identified herein can have activity as exhibited by a catalytic domain of a glucosyltransferase classified under the glycoside hydrolase family 70 (GH70). Such a GH70 glucosyltransferase may be found in the CAZy (Carbohydrate-Active EnZymes) database (Cantarel et al., *Nucleic Acids Res.* 37:D233-238, 2009), for example.

Still further examples of parent glucosyltransferase enzymes in a polynucleotide preparation method herein can be any as disclosed herein and that include 1-300 (or any integer there between [e.g., 10, 15, 20, 25, 30, 35, 40, 45, or 50]) residues on the N-terminus and/or C-terminus. Such additional residues may be from a corresponding wild type sequence from which the glucosyltransferase enzyme is derived, or may be a heterologous sequence such as an epitope tag (at either N- or C-terminus) or a heterologous signal peptide (at N-terminus), for example. Examples of such parent glucosyltransferase enzymes comprise an amino acid sequence that is 100% identical to, or at least 90%, 91%, 92%, 93%, 94%, 95%, 96%, 97%, 98%, 98.5%, 99%, or 99.5% identical to, SEQ ID NO:65, 30, 4, 28, or 20. These sequences (SEQ ID NO:65, 30, 4, 28, 20) lack an N-terminal signal peptide (as well as a variable domain) (refer to Table 1). Still other examples of parent glucosyltransferase enzymes herein include those comprising an amino acid sequence that is 100% identical to, or at least 90%, 91%, 92%, 93%, 94%, 95%, 96%, 97%, 98%, 98.5%, 99%, or 99.5% A identical to, SEQ ID NO:60, 61, 62, 63, or 64.

A parent glucosyltransferase identified in a polynucleotide preparation method herein can, for instance, synthesize insoluble poly alpha-1,3-glucan having at least 95% alpha-1,3 glycosidic linkages and $DP_w$ of at least 100. In certain embodiments, a parent glucosyltransferase enzyme can synthesize poly alpha-1,3-glucan in which at least about 95%, 96%, 97%, 98%, 99%, or 100% of the constituent glycosidic linkages are alpha-1,3 linkages. In such embodiments, accordingly, the glucosyltransferase enzyme synthesizes poly alpha-1,3-glucan in which there is less than about 5%, 4%, 3%, 2%, 1%, or 0% of glycosidic linkages that are not alpha-1,3.

In another aspect, a parent glucosyltransferase enzyme can synthesize poly alpha-1,3-glucan having no branch points or less than about 5%, 4%, 3%, 2%, or 1% branch points as a percent of the glycosidic linkages in the polymer. Examples of branch points include alpha-1,6 branch points.

In still another aspect, a parent glucosyltransferase enzyme can synthesize poly alpha-1,3-glucan having a molecular weight in $DP_w$ or $DP_n$ of at least about 100. Alternatively, a parent glucosyltransferase enzyme may synthesize poly alpha-1,3-glucan having a molecular weight in $DP_n$ or $DP_w$ of at least about 400. Alternatively still, a parent glucosyltransferase enzyme may synthesize poly alpha-1,3-glucan having a molecular weight in $DP_n$ or $DP_w$ of at least about 100, 150, 200, 250, 300, 350, 400, 450, 500, 550, 600, 650, 700, 750, 800, 850, 900, 950, or 1000 (or any integer between 100 and 1000).

A method of preparing a polynucleotide sequence encoding a glucosyltransferase that produces a branched alpha-glucan polymer comprises step (b) of modifying the polynucleotide sequence (encoding a parent glucosyltransferase) identified in step (a). Such modification deletes and/or mutates (removes) at least one of motifs (i), (ii), or (iii) encoded by the polynucleotide sequence.

Modification of sequence encoding motif (i), (ii) and/or (iii) herein allows expression of a child glucosyltransferase with a catalytic domain that does not comprise amino acid sequence(s) that is/are at least 90% identical to SEQ ID NO:78 (motif i), SEQ ID NO:79 (motif ii), and/or SEQ ID NO:80 (motif iii). In some embodiments, a child glucosyltransferase comprises a catalytic domain that does not comprise amino acid sequence(s) that is/are at least 90%, 89%, 88%, 87%, 86%, 85%, 84%, 83%, 82%, 81%, 80%, 79%, 78%, 77%, 76%, 75%, 74%, 73%, 72%, 71%, 70%, 69%, 68%, 67%, 66%, 65%, 64%, 63%, 62%, 61%, 60%, 59%, 58%, 57%, 56%, 55%, 54%, 53%, 52%, 51%, 50%, 49%, 48%, 47%, 46%, 45%, 44%, 43%, 42%, 41%, or 40% identical to SEQ ID NO:78, SEQ ID NO:79, and/or SEQ ID NO:80. Since a parent glucosyltransferase can comprise a catalytic domain that is at least 90% identical to positions 54-957 of SEQ ID NO:65, a child glucosyltransferase typically comprises a catalytic domain that has an amino acid sequence that is at least 90%, 91%, 92%, 93%, 94%, 95%, 96%, 97%, 98%, 99%, or 100% identical to positions 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97 (each of these sequences comprises one or more deleted motifs compared to positions 54-957 of SEQ ID NO:65).

A deletion or mutation can be directed to motif (i) only, motif (ii) only, motif (iii) only, both motifs (i) and (ii), both motifs (i) and (iii), both motifs (ii) and (iii), and all three of motifs (i), (ii) and (iii), for example. In certain embodiments, modification step (b) comprises deleting at least one of motifs (i), (ii), or (iii) encoded by the polynucleotide sequence identified in step (a). Such deletion can comprise removing most of (e.g., more than 70%, 80%, or 90% of), or all off, one or more sequences encoding motif (i), (ii), or (iii).

If motif (i) is deleted or mutated, then the encoded child glucosyltransferase can have a catalytic domain comprising an amino acid sequence that is at least 90% identical to positions 54-941 of SEQ ID NO:85, for example.

If motif (ii) is deleted or mutated, then the encoded child glucosyltransferase can have a catalytic domain comprising an amino acid sequence that is at least 90% identical to positions 54-927 of SEQ ID NO:87, for example.

If motif (iii) is deleted or mutated, then the encoded child glucosyltransferase can have a catalytic domain comprising an amino acid sequence that is at least 90% identical to positions 54-935 of SEQ ID NO:89, for example.

If motifs (i) and (ii) are deleted or mutated, then the encoded child glucosyltransferase can have a catalytic domain comprising an amino acid sequence that is at least 90% identical to positions 54-911 of SEQ ID NO:91, for example.

If motifs (i) and (iii) are deleted or mutated, then the encoded child glucosyltransferase can have a catalytic domain comprising an amino acid sequence that is at least 90% identical to positions 54-919 of SEQ ID NO:93, for example.

If motifs (ii) and (iii) are deleted or mutated, then the encoded child glucosyltransferase can have a catalytic domain comprising an amino acid sequence that is at least 90% identical to positions 54-905 of SEQ ID NO:95, for example.

If motifs (i), (ii) and (iii) are deleted or mutated, then the encoded child glucosyltransferase can have a catalytic domain comprising an amino acid sequence that is at least 90% identical to positions 54-889 of SEQ ID NO:97, for example.

A deletion or mutation of a polynucleotide in modification step (b) can be made following any DNA manipulation technique known in the art. Modifying step (b) can optionally be performed in silico, followed by synthesis of the polynucleotide sequence encoding a glucosyltransferase enzyme that produces a branched alpha-glucan polymer. For example, a nucleotide sequence identified in step (a) can be manipulated in silico using a suitable sequence manipulation program/software (e.g., VECTOR NTI, Life Technologies, Carlsbad, Calif.; DNAStrider; DNASTAR, Madison, Wis.). Following such virtual manipulation, the modified polynucleotide sequence can be artificially synthesized by any suitable technique (e.g., annealing-based connection of oligonucleotides, or any technique disclosed in Hughes et al., *Methods Enzymol.* 498:277-309, which is incorporated herein by reference). It should be appreciated that the foregoing methodology is not believed to rely on having a pre-existing polynucleotide sequence in hand.

Alternatively, modifying step (b) can optionally be performed using a physical copy of a polynucleotide sequence identified in step (a) encoding a parent glucosyltransferase. As an example, such a polynucleotide can serve as a template for amplification using primers designed in a manner such that the amplified product has one or more deletions (e.g., refer to Innis et al., above).

Suitable types of mutations that can be applied in step (b) in some aspects herein include those resulting in an amino acid substitution. One or more substitutions typically are non-conservative amino acid changes.

A glucosyltransferase encoded by the polynucleotide sequence produced in step (b) (i.e., child glucosyltransferase) can produce branched alpha-glucan. In some embodiments, alpha-glucan polymer branching can be gauged using measurements of intrinsic viscosity and/or branching index (g'), as described above and in the below Examples.

Alpha-glucan polymer branching herein can, in some aspects, be judged with respect to measurements made against poly alpha-1,3-glucan containing at least 95%, 96%, 97%, 98%, or 99% alpha-1,3 glycosidic linkages (such polymer is expected to be mostly unbranched), or 100% alpha-1,3 glycosidic linkages (such polymer is linear/unbranched). Measurements can be with respect to intrinsic viscosity and/or branching index, for example. In certain embodiments, alpha-glucan produced by a child glucosyltransferase herein can have an intrinsic viscosity and/or branching index (each measurement per methodology disclosed in below Examples, for example) that is reduced by at least about 30%, 40%, 50%, 60%, 70%, 80%, or 90% compared to poly alpha-1,3-glucan synthesized by a parent glucosyltransferase identified in step (a).

A branched alpha-glucan polymer produced by a child glucosyltransferase herein is believed to contain at least both alpha-1,3 and alpha-1,6 glycosidic linkages, for example. A branched alpha-glucan polymer may possibly further comprise alpha-1,2 and/or alpha-1,4 glycosidic linkages in some aspects. There are likely no beta-glycosidic linkages present. In certain embodiments, branched alpha-glucan polymer can have less than 94%, 93%, 92%, 91%, 90%, 85%, 80%, 75%, 70%, 65%, 60%, 55%, 50%, 45%, 40%, 35%, or 30% alpha-1,3 glycosidic linkages. A branched alpha-glucan polymer can have at least 30%, 35%, 40%, 45%, 50%, 55%, 60%, 65%, or 70% alpha-1,6 glycosidic linkages in some aspects. It is contemplated that, in some aspects, a branch point occurs on average about every 5, 10, 15, 20, 25, 30, 35, or 40 monosaccharide units in a branched alpha-glucan herein.

A branched alpha-glucan polymer in most embodiments is insoluble. Such insolubility is observed in aqueous conditions (e.g., solvent comprising at least 90% water) of generally neutral pH (e.g., between 6-8), for example.

Some embodiments disclosed herein concern a polynucleotide sequence produced following the above method of preparing a polynucleotide sequence. Such a polynucleotide sequence encodes a glucosyltransferase that produces a branched alpha-glucan polymer. Optionally, one or more regulatory sequences are operably linked to the nucleotide sequence, and preferably a promoter sequence is included as a regulatory sequence. Additional possible features of a polynucleotide sequence are described above.

Still other aspects disclosed herein concern a glucosyltransferase (child glucosyltransferase) encoded by such a polynucleotide sequence. Features of such a glucosyltransferase can be any as disclosed above.

Some other embodiments of the present disclosure are drawn to branched alpha-glucan polymer produced by a glucosyltransferase herein (e.g., a child glucosyltransferase herein; a glucosyltransferase comprising SEQ ID NO:85, 87, 89, 91, 93, 95, or 97).

In other embodiments, reaction solutions are disclosed that comprise water, sucrose, and one or more glucosyltransferase enzymes herein that produce a branched alpha-glucan polymer. Other components can optionally be comprised within a reaction solution for synthesizing branched alpha-glucan, such as fructose, glucose, leucrose, and soluble oligosaccharides (e.g., DP2-DP7). It would be understood that certain branched alpha-glucan products herein may be water-insoluble and thus not dissolved in a glucan synthesis reaction, but rather may be present out of solution. A reaction solution herein may be one that, in addition to producing insoluble glucan product, produces byproducts such as leucrose and/or soluble oligosaccharides.

The temperature of a reaction solution herein can be controlled, if desired. In certain embodiments, the temperature of the reaction can be between about 5° C. to about 50° C. The temperature in certain other embodiments can be between about 20° C. to about 40° C., or about 20° C. to about 30° C. (e.g., about 22-25° C.).

The initial concentration of sucrose in a reaction solution herein can be about 20 g/L to about 400 g/L, for example. Alternatively, the initial concentration of sucrose can be about 75 g/L to about 175 g/L, or from about 50 g/L to about 150 g/L. Alternatively still, the initial concentration of sucrose can be about 40, 50, 60, 70, 80, 90, 100, 110, 120, 130, 140, 150, or 160 g/L (or any integer value between 40 and 160 g/L), for example. "Initial concentration of sucrose" refers to the sucrose concentration in a GTF reaction solution just after all the reaction solution components have been added (e.g., at least water, sucrose, GTF enzyme).

Sucrose used in a glucan synthesis reaction herein can be highly pure (≥99.5%) or be of any other purity or grade. For example, sucrose can have a purity of at least 99.0%, or can be reagent grade sucrose. As another example, incompletely refined sucrose can be used. Incompletely refined sucrose herein refers to sucrose that has not been processed to white refined sucrose. Thus, incompletely refined sucrose can be completely unrefined or partially refined. Examples of unrefined sucrose are "raw sucrose" ("raw sugar") and solutions thereof. Examples of partially refined sucrose have not gone through one, two, three, or more crystallization steps. The ICUMSA (International Commission for Uniform Methods of Sugar Analysis) of incompletely refined sucrose herein can be greater than 150, for example. Sucrose herein may be derived from any renewable sugar source such as sugar cane, sugar beets, cassava, sweet sorghum, or corn. Suitable forms of sucrose useful herein are crystalline form or non-crystalline form (e.g., syrup, cane juice, beet juice), for example.

Methods of determining ICUMSA values for sucrose are well known in the art and disclosed by the International Commission for Uniform Methods of Sugar Analysis in *ICUMSA Methods of Sugar Analysis: Official and Tentative Methods Recommended by the International Commission for Uniform Methods of Sugar Analysis* (ICUMSA) (Ed. H. C. S. de Whalley, Elsevier Pub. Co., 1964), for example, which is incorporated herein by reference. ICUMSA can be measured, for example, by ICUMSA Method GS1/3-7 as described by R. J. McCowage, R. M. Urquhart and M. L. Burge (*Determination of the Solution Colour of Raw Sugars,*

*Brown Sugars and Coloured Syrups at pH 7.0—Official*, Verlag Dr Albert Bartens, 2011 revision), which is incorporated herein by reference.

The pH of a glucan synthesis reaction in certain embodiments can be between about 4.0 to about 8.0. Alternatively, the pH can be about 4.0, 4.5, 5.0, 5.5, 6.0, 6.5, 7.0, 7.5, or 8.0. The pH can be adjusted or controlled by the addition or incorporation of a suitable buffer, including but not limited to: phosphate, tris, citrate, or a combination thereof. Buffer concentration in a glucan synthesis reaction can be from 0 mM to about 100 mM, or about 10, 20, or 50 mM, for example.

One or more different glucosyltransferase enzymes that produce branched alpha-glucan may be used in certain aspects. A reaction solution herein may contain one, two, or more glucosyltransferase enzymes, for example.

The present disclosure also concerns a method for producing branched alpha-glucan polymer, the method comprising:
(a) contacting at least water, sucrose, and one or more glucosyltransferase enzymes as disclosed herein that produce branched alpha-glucan polymer, whereby branched alpha-glucan polymer is produced, and
b) optionally, isolating the alpha-glucan polymer produced in step (a).

A glucan synthesis method as presently disclosed comprises contacting at least water, sucrose, and a glucosyltransferase enzyme as described herein that synthesizes branched alpha-glucan. These and optionally other reagents can be added altogether or added in any order as discussed below. This step can comprise providing a reaction solution comprising water, sucrose and a glucosyltransferase enzyme that synthesizes branched alpha-glucan. In certain embodiments in which insoluble branched alpha-glucan is synthesized by a glucosyltransferase, it would be understood that the reaction solution becomes a reaction mixture given that insoluble glucan polymer falls out of solution. The contacting step herein can be performed in any number of ways. For example, the desired amount of sucrose can first be dissolved in water (optionally, other components may also be added at this stage of preparation, such as buffer components), followed by addition of glucosyltransferase enzyme. The solution may be kept still, or agitated via stirring or orbital shaking, for example. Typically, a glucan synthesis reaction is cell-free.

Completion of a reaction in certain embodiments can be determined visually (e.g., no more accumulation of insoluble glucan) and/or by measuring the amount of sucrose left in the solution (residual sucrose), where a percent sucrose consumption of over about 90% can indicate reaction completion, for example. Typically, a reaction of the disclosed process will take about 12, 24, 36, 48, 60, 72, 84, or 96 hours to complete, depending on certain parameters such as the amount of sucrose and glucosyltransferase enzyme used in the reaction.

The yield of branched alpha-glucan produced in some aspects of a glucan synthesis method herein can be at least about 5%, 6%, 7%, 8%, 9%, 10%, 11%, 12%, 13%, 14%, 15%, 16%, 17%, 18%, 19%, or 20%, based on the weight of sucrose converted in the reaction.

Branched alpha-glucan produced in the disclosed method may optionally be isolated. For example, insoluble branched alpha-glucan may be separated by centrifugation or filtration. In doing so, the glucan is separated from most of the reaction solution, which may comprise water, fructose and certain byproducts (e.g., leucrose, soluble oligosaccharides DP2-DP7). This solution may also comprise residual sucrose and glucose monomer. Isolation can optionally further comprise washing branched glucan product one, two, or more times with water or other aqueous liquid, and/or drying the glucan product.

The above embodiments of branched alpha-glucan synthesis methods are examples. Any other feature disclosed herein can apply to a branched glucan synthesis method, accordingly. For example, any of the branched glucan product, glucosyltransferase enzyme (e.g., the catalytic domain and its motif profile), and reaction solution condition features disclosed herein can be applied as appropriate.

Non-limiting examples of compositions and methods disclosed herein include:
1. A glucosyltransferase enzyme comprising a catalytic domain that comprises an amino acid sequence that is at least 90% identical to amino acid positions: 54-941 of SEQ ID NO:85, 54-927 of SEQ ID NO:87, 54-935 of SEQ ID NO:89, 54-911 of SEQ ID NO:91, 54-919 of SEQ ID NO:93, 54-905 of SEQ ID NO:95, or 54-889 of SEQ ID NO:97, wherein the catalytic domain lacks at least one motif selected from the group consisting of:
   (i) a motif comprising an amino acid sequence that is at least 90% identical to SEQ ID NO:78,
   (ii) a motif comprising an amino acid sequence that is at least 90% identical to SEQ ID NO:79, and
   (iii) a motif comprising an amino acid sequence that is at least 90% identical to SEQ ID NO:80;
   wherein the glucosyltransferase enzyme produces a branched alpha-glucan polymer.
2. The glucosyltransferase of embodiment 1, wherein the glucosyltransferase comprises an amino acid sequence that is at least 90% identical to SEQ ID NO:85, SEQ ID NO:87, SEQ ID NO:89, SEQ ID NO:91, SEQ ID NO:93, SEQ ID NO:95, or SEQ ID NO:97, and wherein the glucosyltransferase lacks at least one of motifs (i), (ii), or (iii).
3. A polynucleotide comprising a nucleotide sequence encoding a glucosyltransferase enzyme according to embodiment 1 or 2, optionally wherein one or more regulatory sequences are operably linked to the nucleotide sequence, and preferably wherein the one or more regulatory sequences include a promoter sequence.
4. A method of preparing a polynucleotide sequence encoding a glucosyltransferase enzyme that produces a branched alpha-glucan polymer, the method comprising:
   (a) identifying a polynucleotide sequence encoding a parent glucosyltransferase enzyme that comprises a catalytic domain comprising:
      (1) an amino acid sequence that is at least 90% identical to amino acid positions 54-957 of SEQ ID NO:65, and
      (2) the following three motifs:
         (i) a motif comprising an amino acid sequence that is at least 90% identical to SEQ ID NO:78,
         (ii) a motif comprising an amino acid sequence that is at least 90% identical to SEQ ID NO:79, and
         (iii) a motif comprising an amino acid sequence that is at least 90% identical to SEQ ID NO:80; and
   (b) modifying the polynucleotide sequence identified in step (a) to delete and/or mutate at least one of motifs (i), (ii), or (iii) encoded by the polynucleotide sequence, thereby providing a polynucleotide sequence encoding a glucosyltransferase enzyme that produces a branched alpha-glucan polymer.
5. The method of embodiment 4, wherein:
   (A) the position of the amino acid sequence that is at least 90% identical to SEQ ID NO:78 aligns with amino acid positions 231-243 of SEQ ID NO:65;
   (B) the position of the amino acid sequence that is at least 90% identical to SEQ ID NO:79 aligns with amino acid positions 396-425 of SEQ ID NO:65; and/or (C) the position of the amino acid sequence that is at least 90% identical to SEQ ID NO:80 aligns with amino acid positions 549-567 of SEQ ID NO:65.

6. The method of embodiment 4 or 5, wherein motif (i) comprises SEQ ID NO:78, motif (ii) comprises SEQ ID NO:79, and motif (iii) comprises SEQ ID NO:80.

7. The method of embodiment 4, 5, or 6, wherein the parent glucosyltransferase enzyme can synthesize poly alpha-1,3-glucan having at least 95% alpha-1,3 glycosidic linkages and a weight average degree of polymerization ($DP_w$) of at least 100.

8. The method of embodiment 4, 5, 6, or 7, wherein modification step (b) comprises deleting at least one of motifs (i), (ii), or (iii) encoded by the polynucleotide sequence identified in step (a).

9. The method of embodiment 4, 5, 6, 7, or 8, wherein the glucosyltransferase enzyme of step (b) comprises a catalytic domain that does not comprise at least one amino acid sequence that is at least 60% identical to SEQ ID NO:78, SEQ ID NO:79, or SEQ ID NO:80.

10. The method of embodiment 4, 5, 6, 7, 8, or 9, wherein the branched alpha-glucan polymer has an intrinsic viscosity and/or branching index that is reduced by at least 30% compared to the intrinsic viscosity and/or branching index of poly alpha-1,3-glucan synthesized by the parent glucosyltransferase.

11. The method of embodiment 4, 5, 6, 7, 8, 9, or 10, wherein the identifying step is performed:
   (a) in silico,
   (b) with a method comprising a nucleic acid hybridization step,
   (c) with a method comprising a protein sequencing step, and/or
   (d) with a method comprising a protein binding step;
and/or wherein the modifying step is performed:
   (e) in silico, followed by synthesis of the polynucleotide sequence encoding the glucosyltransferase enzyme that produces a branched alpha-glucan polymer, or
   (f) using a physical copy of the polynucleotide sequence encoding the parent glucosyltransferase.

12. A polynucleotide sequence encoding a glucosyltransferase enzyme that produces a branched alpha-glucan polymer, wherein the polynucleotide sequence is produced according to the method of embodiment 4, 5, 6, 7, 8, 9, 10, or 11, optionally wherein the polynucleotide sequence further comprises one or more regulatory sequences operably linked to the polynucleotide sequence, preferably wherein the one or more regulatory sequences include a promoter sequence.

13. A glucosyltransferase enzyme encoded by the polynucleotide of embodiment 12.

14. A reaction solution comprising water, sucrose, and a glucosyltransferase enzyme according to embodiment 1, 2, or 13.

15. A method for producing a branched alpha-glucan polymer comprising:
   (a) contacting at least water, sucrose, and a glucosyltransferase enzyme according to embodiment 1, 2, or 13, whereby branched alpha-glucan polymer is produced, and
   b) optionally, isolating the branched alpha-glucan polymer produced in step (a).

16. A branched alpha-glucan polymer, wherein the polymer is produced from a method according to embodiment 15 or from a reaction solution according to embodiment 14, or wherein the polymer is a product of a glucosyltransferase according to any of embodiments 1-2.

EXAMPLES

The present disclosure is further exemplified in the following Examples. It should be understood that these Examples, while indicating certain preferred aspects herein, are given by way of illustration only. From the above discussion and these Examples, one skilled in the art can ascertain the essential characteristics of the disclosed embodiments, and without departing from the spirit and scope thereof, can make various changes and modifications to adapt the disclosed embodiments to various uses and conditions.

Abbreviations

The meanings of some of the abbreviations used herein are as follows: "g" means gram(s), "h" means hour(s), "mL" means milliliter(s), "psi" means pound(s) per square inch, "wt %" means weight percentage, "µm" means micrometer(s), "° C." means degrees Celsius, "mg" means milligram(s), "mm" means millimeter(s), "µL" means microliter(s), "mmol" means millimole(s), "min" means minute(s), "mol %" means mole percent, "M" means molar, "rpm" means revolutions per minute, "MPa" means mega-Pascals, "IV" means intrinsic viscosity, "g" means branching ratio.

General Methods

Preparation of Crude Extracts of Glucosyltransferase (GTF) Enzymes

GTF enzymes were prepared as follows. E. coli TOP10® cells (Invitrogen, Carlsbad, Calif.) were transformed with a pJexpress404®-based construct containing a particular GTF-encoding DNA sequence. Each sequence was codon-optimized to express the GTF enzyme in E. coli. Individual E. coli strains expressing a particular GTF enzyme were grown in LB (Luria broth) medium (Becton, Dickinson and Company, Franklin Lakes, N.J.) with ampicillin (100 µg/mL) at 37° C. with shaking to $OD_{600}$=0.4-0.5, at which time IPTG (isopropyl beta-D-1-thiogalactopyranoside, Cat. No. 16758, Sigma-Aldrich, St. Louis, Mo.) was added to a final concentration of 0.5 mM. The cultures were incubated for 2-4 hours at 37° C. following IPTG induction. Cells were harvested by centrifugation at 5,000×g for 15 minutes and resuspended (20% w/v) in 50 mM phosphate buffer pH 7.0 supplemented with dithiothreitol (DTT, 1.0 mM). Resuspended cells were passed through a French Pressure Cell (SLM Instruments, Rochester, N.Y.) twice to ensure >95% cell lysis. Lysed cells were centrifuged for 30 minutes at 12,000 x g at 4° C. The resulting supernatant was analyzed by the BCA (bicinchoninic acid) protein assay (Sigma-Aldrich) and SDS-PAGE to confirm expression of the GTF enzyme, and the supernatant was stored at −20° C.

Determination of GTF Enzymatic Activity

GTF enzyme activity was confirmed by measuring the production of reducing sugars (fructose and glucose) in a GTF reaction solution. A reaction solution was prepared by adding a GTF extract (prepared as above) to a mixture containing sucrose (50 or 150 g/L), potassium phosphate buffer (pH 6.5, 50 mM), and optionally dextran (1 mg/mL, dextran T10, Cat. No. D9260, Sigma-Aldrich); the GTF extract was added to 2.5%-5% by volume. The reaction solution was then incubated at 22-25° C. for 24-30 hours, after which it was centrifuged. Supernatant (0.01 mL) was added to a mixture containing 1 N NaOH and 0.1% triphenyltetrazolium chloride (Sigma-Aldrich). The mixture was incubated for five minutes after which its $OD_{480}$ was determined using an ULTROSPEC spectrophotometer (Pharmacia LKB, New York, N.Y.) to gauge the presence of the reducing sugars fructose and glucose.

Determination of Glycosidic Linkages

Glycosidic linkages in the glucan product synthesized by a GTF enzyme were determined by $^{13}C$ NMR (nuclear magnetic resonance). Dry glucan polymer (25-30 mg) was dissolved in 1 mL of deuterated dimethyl sulfoxide (DMSO) containing 3% by weight of LiCl with stirring at 50° C. Using a glass pipet, 0.8 mL of the solution was transferred into a 5-mm NMR tube. A quantitative $^{13}C$ NMR spectrum was acquired using a Bruker Avance 500-MHz NMR spectrometer (Billerica, Mass.) equipped with a CPDUL cryo-probe at a spectral frequency of 125.76 MHz, using a spectral window of 26041.7 Hz. An inverse gated decoupling pulse sequence using waltz decoupling was used with an acquisition time of 0.629 second, an inter-pulse delay of 5 seconds, and 6000 pulses. The time domain data was transformed using an exponential multiplication of 2.0 Hz.

Determination of Number Average Degree of Polymerization $DP_n$)

The $DP_n$ of a glucan product synthesized by a GTF enzyme was determined by size-exclusion chromatography (SEC). Dry glucan polymer was dissolved at 5 mg/mL in N,N-dimethyl-acetamide (DMAc) and 5% LiCl with overnight shaking at 100° C. The SEC system used was an Alliance™ 2695 separation module from Waters Corporation (Milford, Mass.) coupled with three on-line detectors: a differential refractometer 2410 from Waters, a multiangle light scattering photometer Heleos™ 8+ from Wyatt Technologies (Santa Barbara, Calif.), and a differential capillary viscometer ViscoStar™ from Wyatt. The columns used for SEC were four styrene-divinyl benzene columns from Shodex (Japan) and two linear KD-806M, KD-802 and KD-801 columns to improve resolution at the low molecular weight region of a polymer distribution. The mobile phase was DMAc with 0.11% LiCl. The chromatographic conditions used were 50° C. in the column and detector compartments, 40° C. in the sample and injector compartment, a flow rate of 0.5 mL/min, and an injection volume of 100 μL. The software packages used for data reduction were Empower™ version 3 from Waters (calibration with broad glucan polymer standard) and Astra® version 6 from Wyatt (triple detection method with column calibration).

Determination of Intrinsic Viscosity

Multidetector size exclusion chromatography (SEC) allowed measurement of molar mass distribution (MMD) using a combination of light scattering (LS) photometer and differential refractometer (DR). Molar mass (M) of the separated fractions across the polymer distribution was measured as a ratio of two detector responses:

M~LS/DR, without any column calibration.

In a similar way, an in-line differential viscometer (DV) allowed measurement of intrinsic viscosity (IV) of the separated fractions:

IV~DV/DR.

By plotting IV as a function of M in log-log scale, a so-called Mark-Houwink plot was obtained for samples tested.

Determination of Branching Ratio

Mark-Houwink (MH) plots were useful for estimating the degree of branching in polymers through measuring their size as a function of molar mass. Thus, the hydrodynamic size (H) of the macromolecule in dilute solution was determined as $H=IV \times M$, so that using an MH plot, it could be seen how the size of the polymer chain changes with its molar mass. Branched polymer has a smaller size in solution than its linear counterpart with the same molar mass, and the position of the MH-plot indicates the degree of polymer branching.

To quantify the degree of branching, the branching ratio (or branching index) g' was plotted as a function of molar mass. This index is defined as a ratio of hydrodynamic volume of branched polymer chain $H_{br}$ with a given molar mass M, to the similar volume $H_{lin}$ of the linear chain with the same molar mass; i.e., $g'(M)=H_{br}/H_{lin}$. Since H is defined as a production of IV and M, and M is the same in both numerator and denominator, then g' could be determined for each separated fraction with molar mass M directly from the corresponding MH plots as $g'=IV_{br}/IV_{lin}$. These plots show how the degree of branching changes with the polymer molar mass. The weight-average branching index for each polymer (i.e., $g'=IV_{br,w}/IV_{lin,w}$) was a useful estimation of the overall branching frequency in the polydispersed polymer. A g' value of 1, per this analysis, indicates that a polymer is linear (unbranched), whereas a g' value<1 indicates that a polymer is branched.

Example 1

Production of GTF Enzymes

This Example describes the preparation of N-terminally truncated versions of glucosyltransferase (GTF) enzymes used in this study.

Nucleotide sequences encoding N-terminally truncated versions of GTF enzymes (Table 2, GTF ID) were synthesized using codons optimized for protein expression in *E. coli*. The nucleic acid products (Table 2, nt SEQ ID NO) encoding the GTF enzymes (Table 2, AA SEQ ID NO) were subcloned into pJexpresss404® (DNA2.0, Menlo Park, Calif.) to generate GTF expression plasmids (Table 2, plasmid ID). The GTF expression plasmids were used to transform *E. coli* TOP10 cells (Invitrogen, Carlsbad, Calif.) to generate GTF expression strains (Table 2, strain ID). Production of GTF enzymes by bacterial expression and determination of enzymatic activities were performed as described in General Methods.

TABLE 2

Production of GTF Enzymes

| GTF ID | GI No.[a] | nt SEQ ID NO | AA SEQ ID NO | Plasmid ID | Strain ID |
|---|---|---|---|---|---|
| 0874 | 450874 | 1 | 2 | pMP53 | TOP10/pMP53 |
| 6855 | 228476855 | 3 | 4 | pMP66 | TOP10/pMP66 |
| 2379 | 662379 | 5 | 6 | pMP65 | TOP10/pMP65 |
| 7527 | 47527 | 7 | 8 | pMP52 | TOP10/pMP52 |
| 1724 | 121724 | 9 | 10 | pMP55 | TOP10/pMP55 |
| 0544 | 290580544 | 11 | 12 | pMP67 | TOP10/pMP67 |
| 5926 | 167735926 | 13 | 14 | pMP56 | TOP10/pMP56 |
| 4297 | 7684297 | 15 | 16 | pMP70 | TOP10/pMP70 |
| 5618 | 328945618 | 17 | 18 | pMP72 | TOP10/pMP72 |
| 2765 | 322372765 | 19 | 20 | pMP85 | TOP10/pMP85 |
| 4700 | 21654700 | 21 | 22 | pMP83 | TOP10/pMP83 |
| 1366 | 146741366 | 23 | 24 | pMP86 | TOP10/pMP86 |
| 0427 | 940427 | 25 | 26 | pMP87 | TOP10/pMP87 |
| 2919 | 383282919 | 27 | 28 | pMP88 | TOP10/pMP88 |
| 2678 | 400182678 | 29 | 30 | pMP89 | TOP10/pMP89 |
| 2381 | 662381 | 31 | 32 | pMP96 | TOP10/pMP96 |
| 3929 | 387783929 | 33 | 34 | pMP97 | TOP10/pMP97 |
| 6907 | 228476907 | 35 | 36 | pMP57 | TOP10/pMP57 |
| 6661 | 228476661 | 37 | 38 | pMP62 | TOP10/pMP62 |
| 0339 | 334280339 | 39 | 40 | pMP73 | TOP10/pMP73 |
| 0088 | 3130088 | 41 | 42 | pMP69 | TOP10/pMP69 |

TABLE 2-continued

Production of GTF Enzymes

| GTF ID | GI No.[a] | nt SEQ ID NO | AA SEQ ID NO | Plasmid ID | Strain ID |
|---|---|---|---|---|---|
| 9358 | 24379358 | 43 | 44 | pMP71 | TOP10/pMP71 |
| 8242 | 325978242 | 45 | 46 | pMP68 | TOP10/pMP68 |
| 3442 | 324993442 | 47 | 48 | pMP75 | TOP10/pMP75 |
| 7528 | 47528 | 49 | 50 | pMP77 | TOP10/pMP77 |
| 3279 | 322373279 | 51 | 52 | pMP79 | TOP10/pMP79 |
| 6491 | 170016491 | 53 | 54 | pMP74 | TOP10/pMP74 |
| 6889 | 228476889 | 55 | 56 | pMP60 | TOP10/pMP60 |
| 4154 | 51574154 | 57 | 58 | pMP80 | TOP10/pMP80 |
| 3298 | 322373298 |  | 59 | pMP98 | TOP10/pMP98 |

[a]GI number as provided for each respective sequence in GENBANK database (NCBI).

Example 2

Production of Glucan Polymer using GTF Enzymes

This Example describes using the GTF enzymes prepared in Example 1 to synthesize glucan polymer.

Polymerization reactions were performed with each of the GTF enzymes prepared in Example 1. Reaction solutions were prepared comprising sucrose (50 g/L), potassium phosphate buffer (pH 6.5, 20 mM) and a GTF enzyme (2.5% extract by volume). After 24-30 hours at 22-25° C., insoluble glucan polymer product was harvested by centrifugation, washed three times with water, washed once with ethanol, and dried at 50° C. for 24-30 hours.

Glycosidic linkages in each insoluble glucan polymer product were determined by $^{13}$C NMR, and the $DP_n$ for each insoluble polymer product was determined by SEC, as described in General Methods. These measurements are provided in Table 3 below.

TABLE 3

Polymer produced by GTF enzymes

| GTF ID | SEQ ID NO. | Reducing Sugars | Insoluble Product | Glucan Polymer Linkages %1.3 | Glucan Polymer Linkages %1.6 | $DP_n$ |
|---|---|---|---|---|---|---|
| 0874 | 2 | yes | yes | 100 | 0 | 60 |
| 6855 | 4 | yes | yes | 100 | 0 | 440 |
| 2379 | 6 | yes | yes | 37 | 63 | 310 |
| 7527 | 8 | yes | yes | 100 | 0 | 440 |
| 1724 | 10 | yes | yes | 100 | 0 | 250 |
| 0544 | 12 | yes | yes | 62 | 36 | 980 |
| 5926 | 14 | yes | yes | 100 | 0 | 260 |
| 4297 | 16 | yes | yes | 31 | 67 | 800 |
| 5618 | 18 | yes | yes | 34 | 66 | 1020 |
| 2765 | 20 | yes | yes | 100 | 0 | 280 |
| 4700 | 22 | yes | no | | | |
| 1366 | 24 | yes | no | | | |
| 0427 | 26 | yes | yes | 100 | 0 | 120 |
| 2919 | 28 | yes | yes | 100 | 0 | 250 |
| 2678 | 30 | yes | yes | 100 | 0 | 390 |
| 2381 | 32 | yes | no | | | |
| 3929 | 34 | yes | yes | 100 | 0 | 280 |
| 6907 | 36 | yes | no | | | |
| 6661 | 38 | yes | no | | | |
| 0339 | 40 | yes | no | | | |
| 0088 | 42 | yes | no | | | |
| 9358 | 44 | yes | no | | | |
| 8242 | 46 | yes | no | | | |
| 3442 | 48 | yes | no | | | |
| 7528 | 50 | yes | no | | | |
| 3279 | 52 | yes | no | | | |
| 6491 | 54 | yes | no | | | |
| 6889 | 56 | yes | no | | | |
| 4154 | 58 | yes | no | | | |
| 3298 | 59 | yes | no | 50 | 50 | |
| none | na | no | no | | | |

The following GTF enzymes produced glucan polymers comprising at least 50% alpha-1,3-linkages and having a $DP_n$ of at least 100: 6855 (SEQ ID NO:4), 7527 (SEQ ID NO:8), 1724 (SEQ ID NO:10), 0544 (SEQ ID NO:12), 5926 (SEQ ID NO:14), 2765 (SEQ ID NO:20), 0427 (SEQ ID NO:26), 2919 (SEQ ID NO:28), 2678 (SEQ ID NO:30), and 3929 (SEQ ID NO:34) (refer to Table 3). The following GTF enzymes produced glucan polymers comprising 100% alpha-1,3-linkages, indicating linear polymers: 6855 (SEQ ID NO:4), 7527 (SEQ ID NO:8), 1724 (SEQ ID NO:10), 5926 (SEQ ID NO:14), 2765 (SEQ ID NO:20), 0427 (SEQ ID NO:26), 2919 (SEQ ID NO:28), 2678 (SEQ ID NO:30), and 3929 (SEQ ID NO:34). These results clearly indicate that not all GTF enzymes are capable of producing linear alpha-1,3-glucan polymer.

Example 3

Structure/Function Relationships Observed in GTF Sequences

This Example describes aligning the amino acid sequences of several GTF enzymes to determine whether they share any structures.

GTF enzymes were evaluated in Example 2 for their ability to produce glucan polymers with a focus on those enzymes that produce glucan with 100% alpha-1,3-linkages. The sequences of several of these enzymes were aligned with three dimensional structures that are formed by certain S. mutans and L. reuteri GTF sequences (3AIE [SEQ ID NO:66] and 3KLK [SEQ ID NO:67], respectively); the S. mutans and L. reuteri GTF sequences were aligned to superpose common tertiary structures using the software package MOE (Chemical Computing Group, Montreal, Canada). The sequences for each of the GTF enzymes used in the alignment contain the catalytic and glucan-binding domains of each enzyme, respectively (i.e., the N-terminal signal peptide and variable domains of each GTF are not included in the alignment). FIGS. 2A-O show the alignment. The sequences of the S. mutans and L. reuteri GTFs for which crystallographic structures are known were included in the alignment; S. mutans GTF is abbreviated as "3AIE" (SEQ ID NO:66) and L. reuteri GTF is abbreviated as "3KLK" (SEQ ID NO:67) in FIGS. 2A-O.

The alignment in FIGS. 2A-O indicates that all the aligned GTF sequences maintain numerous invariant regions (shown with dark background). These invariant sequences are located throughout the catalytic domain of each GTF (based on a homology model as opposed to an experimentally determined structure). The catalytic domains in the aligned GTFs are about 900-950 amino acid residues long and begin after position 1 (artificial start methionine) in each of the sequences shown in FIGS. 2A-O. The sequence following the catalytic domain in each GTF represents the glucan-binding domain. The aligned GTF sequences share as little as 40% sequence identity with the sequences of the known GTF structures (*S. mutans* 3AIE and *L. reuteri* 3KLK). But the alignment of these sequences in FIGS. 2A-O indicates a distributed pattern of conserved sequence motifs and patterns of specific residues that are conserved in all the aligned sequences (residues with dark background in FIGS. 2A-O). These conserved sequence motifs can be related to important structural features such as the catalytic site described below and can serve as reference points to identify unique or characteristic features that may be associated with specific performance benefits.

The catalytic site residues may be found in sequence motifs repeated in all the aligned sequences (FIGS. 2A-O). Specifically, with reference to the sequence from GTF 7527 (SEQ ID N0:65) in FIGS. 2A-O, Arg292 and Asp294 are found in the motif FDxxRxDAxDNV (SEQ ID N0:68) corresponding to Arg475 and Asp477 of *S. mutans* 3AIE GTF and Arg1023 and Asp1025 of *L. reuteri* 3KLK GTF; Glu332 is found in the sequence motif ExWxxxDxxY (SEQ ID N0:69) corresponding to Glu515 in *S. mutans* 3AIE GTF and Glu1063 in *L. reuteri* 3KLK GTF; His434 and Asp435 are found in the sequence motif FxRAHD (SEQ ID NO:70) corresponding to His587 and Asp588 in *S. mutans* 3AIE GTF and His1135 and Asp1136 in *L. reuteri* 3KLK GTF; and Tyr(Y)783 is found in the sequence motif IxNGYAF (SEQ ID N0:71) corresponding to the residues Tyr916 of *S. mutans* 3AIE GTF and Tyr1465 of *L. reuteri* 3KLK GTF.

Thus, the tested GTF enzymes have catalytic domains comprising several highly conserved regions.

Example 4

Sequence Motifs in GTF Enzymes that Synthesize High Molecular Weight Alpha-1,3-Glucan The GTF enzymes whose sequences were aligned in FIGS. 2A-O were further evaluated for their ability to produce glucan polymers with a focus on those enzymes that produce glucan with 100% alpha-1,3-linkages (Table 4).

TABLE 4

Polymer Produced by Various GTF Enzymes

Glucan Polymer Features

| GTF ID | SEQ ID NO. | % Alpha-1,3 Linkages[a] | $DP_w50$[b] | $DP_w150$[b] | % Identity[d] | Cat. Domain Region[e] | % Cat. Domain Identity[f] |
|---|---|---|---|---|---|---|---|
| 7527[c] | 65 | 100 | 910 | 577 | 100 | 54-957 | 100 |
| 2678 | 30 | 100 | 740 | 657 | 94.1 | 55-960 | 94.9 |
| 6855 | 4 | 100 | 835 | 570 | 98.9 | 55-960 | 99.0 |
| 2919 | 28 | 100 | 600 | 414 | 93.1 | 55-960 | 95.5 |
| 2765 | 20 | 100 | 670 | | 93.6 | 55-960 | 96.4 |
| 0088 | 42 | <30 | | | 44.7 | 55-900 | 50.4 |
| 0544 | 12 | 62 | | | 46.7 | 55-900 | 51.2 |
| 0427 | 26 | 100 | 260 | | 43.1 | 55-900 | 51.8 |
| 0874 | 2 | 100 | 105 | 50 | 43.3 | 55-900 | 52.0 |
| 1724 | 10 | 100 | 535 | 55 | 42.9 | 55-900 | 51.3 |
| 5926 | 14 | 100 | 475 | 68 | 46.0 | 55-900 | 50.9 |
| 1366 | 24 | <30 | | | 46.1 | 55-900 | 50.9 |
| 3298 | 59 | <30 | | | 44.1 | 55-910 | 49.8 |
| 2379 | 6 | 37 | | | 44.5 | 60-915 | 50.7 |
| 6907 | 36 | <30 | | | 55.6 | 55-885 | 61.8 |
| 5618 | 18 | 34 | | | 46.2 | 55-905 | 51.4 |
| 4297 | 16 | 31 | | | 46.5 | 55-905 | 51.2 |
| 3442 | 48 | <30 | | | 45.8 | 55-905 | 51.0 |
| 9358 | 44 | <30 | | | 49.7 | 55-915 | 53.6 |
| 6661 | 38 | <30 | | | 45.6 | 55-895 | 50.5 |
| 0339 | 40 | <30 | | | 53.7 | 55-895 | 57.5 |
| 8242 | 46 | <30 | | | 54.1 | 55-910 | 59.4 |

TABLE 4-continued

Polymer Produced by Various GTF Enzymes

Glucan Polymer Features

| GTF ID | SEQ ID NO. | % Alpha-1,3 Linkages[a] | $DP_w50$[b] | $DP_w150$[b] | % Identity[d] | Cat. Domain Region[e] | % Cat. Domain Identity[f] |
|---|---|---|---|---|---|---|---|
| 7528 | 50 | <30 | | | 48.1 | 55-915 | 54.2 |
| 3279 | 52 | <30 | | | 41.8 | 55-900 | 48.7 |

[a]Glucan products having <30% alpha-1,3 linkages were soluble and not further analyzed for $DP_w$.
[b]$DP_w50$ and $DP_w150$ represent, respectively, the $DP_w$ of glucan produced by a GTF in a reaction solution having an initial sucrose concentration of 50 g/L or 150 g/L.
[c]SEQ ID NO: 65 is a shorter version of the 7527 GTF of SEQ ID NO: 8.
[d]Percent identity of respective GTF with SEQ ID NO: 65 (per EMBOSS alignment).
[e]Amino acid position of region within catalytic domain sequence having conservation (FIGS. 2A-O) with other listed GTF sequences (approximate location).
[f]Percent identity of catalytic domain region with amino acid residues 54-957 of SEQ ID NO: 65 (per EMBOSS alignment).

Nine of the aligned GTF enzymes were found to produce glucan with 100% alpha-1,3-linkages, and five of these nine enzymes produced high molecular weight polymer ($DP_w$>400, Table 4). Specifically, the five GTF enzymes that displayed the property of producing high molecular weight glucan with 100% alpha-1,3-linkages are 7527 (SEQ ID NO:65), 2678 (SEQ ID NO:30), 6855 (SEQ ID NO:4), 2919 (SEQ ID NO:28) and 2765 (SEQ ID NO:20). The sequences for each of these GTFs are indicated with a "++" in (FIGS. 2A-O).

Three sequence motifs were found in the amino acid sequences of all five GTF enzymes that produce high molecular weight glucan with 100% alpha-1,3-linkages, and appear as three different "insertions" situated around the catalytic domain of the known GTF structures. Briefly, these sequence motifs are designated as:

Motif 1a (SEQ ID NO: 78):
D/N-K-S-I/V-L-D-E-Q-S-D-P-N-H

Motif 2 (SEQ ID NO: 79):
N-K-D-G-S-K/T-A-Y-N-E-D-G-T-V/A-K-Q/K-S-T-I-G-K-Y-N-E-K-Y-G-D-A-S Motif 3a (SEQ ID NO: 80):
L-P-T-D-G-K-M-D-N/K-S-D-V-E-L-Y-R-T-N/S-E The relative positions of motifs 1a, 2 and 3a align with residues 231-243, 396-425 and 549-567, respectively, of the 7527 GTF sequence (SEQ ID NO:65) in FIGS. 2A-O. These motifs appear to be conserved among GTF enzymes that synthesize high molecular weight alpha-1,3-glucan.

In the alignment shown in FIGS. 2A-O, motif 1a is flanked by upstream and downstream sequences as shown in FIG. 3. Specifically, preceding motif 1a is the sequence SxxRxxN (SEQ ID NO:72), and following motif 1a is the sequence GGxxxLLxNDxDxSNPxVQAExLN (SEQ ID NO:73). Both of these sequences were found in all the aligned GTF sequences and can serve as reference points for identifying motif 1a in other GTF sequences. In the alignment shown in FIGS. 2A-O, motif 2 is flanked by upstream and downstream sequences as shown in FIG. 5. Specifically, preceding motif 2 by about 50 amino acids is the sequence WxxxDxxY (SEQ ID NO:74) and following motif 2 is the sequence YxFxRAHD (SEQ ID NO:75). The downstream sequence (SEQ ID NO:75) includes two of the active site residues, His587 and Asp588 (numbered with respect to the *S. mutans* GTF structure, 3AIE). Both of these sequences were found in all the aligned GTF sequences and can serve as reference points for identifying motif 2 in other GTF sequences. In the alignment shown in FIGS. 2A-O, motif 3a is flanked by upstream and downstream sequences as shown in FIG. 7. Specifically, preceding motif 3a is sequence YxxGGQ (SEQ ID NO:76) and following motif 3a is the sequence VRxG (SEQ ID NO:77). Both of these sequences were found in all the aligned GTF sequences and can serve as reference points for identifying motif 2 in other GTF sequences.

Identification of motifs 1a (SEQ ID NO:78), 2 (SEQ ID NO:79) and 3a (SEQ ID NO:80) in the catalytic domains of GTF enzymes that synthesize high molecular weight glucan having 100% alpha-1,3-glycosidic linkages indicates that each of these motifs may be useful for identifying other GTFs with similar activity.

Example 5

Sequence Motifs in GTF Enzymes that Synthesize Low Molecular Weight Alpha-1,3-Glucan Four GTF enzymes produced low molecular weight glucan having 100% alpha-1,3-linkages (Table 4). Specifically, these enzymes were 5926 (SEQ ID NO: 14), 0427 (SEQ ID NO: 26), 0874 (SEQ ID NO: 2) and 1724 (SEQ ID NO: 10). The sequences for each of these enzymes are indicated with a "+–" in FIGS. 2A-O. Two sequence motifs were found in the amino acid sequences of these GTF enzymes, and appear as two different "insertions" situated around the catalytic domain of the known GTF structures. Briefly, these sequence motifs are designated as:

```
Motif 1b (SEQ ID NO: 81):
D-S/P-R-F-T-Y/F-N-A/Q/P-N-D-P

Motif 3b (SEQ ID NO: 82):
I-G-N-G-E
```

The relative positions of motifs 1b and 3b align with residues 231-243 and 549-553, respectively, of the 7527 GTF sequence (SEQ ID NO:65) in FIGS. 2A-O. Identification of motifs 1b (SEQ ID NO:81) and 3b (SEQ ID NO:82) in the catalytic domains of GTF enzymes that synthesize low molecular weight glucan having 100% alpha-1,3-glycosidic linkages indicates that each of these unique motifs may be useful for identifying other GTFs with similarly activity.

Example 6

Production of GTF Enzyme Lacking Sequence Motif 1a

A nucleotide sequence encoding a polypeptide similar to the 7527 GTF of SEQ ID NO:65, but with a deletion of Motif 1a (Example 4), was synthesized using codons optimized for expression in *E. coli* (DNA 2.0, Menlo Park Calif.). The nucleic acid product (SEQ ID NO:84), encoding GTF protein 7527-NT-dIS1a (SEQ ID NO:85), was subcloned into pJexpress404® (DNA 2.0, Menlo Park Calif.) to generate the plasmid identified as pMP101. Plasmid pMP101 was used to transform *E. coli* TOP10 cells to generate the strain identified as TOP10/pMP101. It is noted that a GTF catalytic domain sequence is located at amino acid positions 54-941 (approximate) of SEQ ID NO:85.

Production of 7527-NT-dIS1a enzyme (SEQ ID NO:85) with *E. coli* and production of glucan polymer using this enzyme were performed as described above (General Methods). The glucan product is insoluble, and likely comprises only alpha-glycosidic linkages. The intrinsic viscosity and branching of the glucan product (analyzed as described in General Methods) are listed in Table 5 below.

Example 7

Production of GTF Enzyme Lacking Sequence Motif 2

A nucleotide sequence encoding a polypeptide similar to the 7527 GTF of SEQ ID NO:65, but with a deletion of Motif 2 (Example 4), was synthesized using codons optimized for expression in *E. coli* (DNA 2.0, Menlo Park Calif.). The nucleic acid product (SEQ ID NO:86), encoding GTF protein 7527-NT-dIS2 (SEQ ID NO:87), was subcloned into pJexpress404® to generate the plasmid identified as pMP102. Plasmid pMP102 was used to transform *E. coli* TOP10 cells to generate the strain identified as TOP10/pMP102. It is noted that a GTF catalytic domain sequence is located at amino acid positions 54-927 (approximate) of SEQ ID NO:87.

Production of 7527-NT-dIS2 (SEQ ID NO:87) with *E. coli* and production of glucan polymer using this enzyme were performed as described above (General Methods). The glucan product is insoluble, and likely comprises only alpha-glycosidic linkages. The intrinsic viscosity and branching of the glucan product (analyzed as described in General Methods) are listed in Table 5 below.

Example 8

Production of GTF Enzyme Lacking Sequence Motif 3a

A nucleotide sequence encoding a polypeptide similar to the 7527 GTF of SEQ ID NO:65, but with a deletion of Motif 3a (Example 4), was synthesized using codons optimized for expression in *E. coli* (DNA 2.0, Menlo Park Calif.). The nucleic acid product (SEQ ID NO:88), encoding GTF protein 7527-NT-dIS3a (SEQ ID NO:89), was subcloned into pJexpress404® to generate the plasmid identified as pMP103. Plasmid pMP103 was used to transform *E. coli* TOP10 cells to generate the strain identified as TOP10/pMP103. It is noted that a GTF catalytic domain sequence is located at amino acid positions 54-935 (approximate) of SEQ ID NO:89.

Production of 7527-NT-dIS3a (SEQ ID NO:89) with *E. coli* and production of glucan polymer using this enzyme were performed as described above (General Methods). The glucan product is insoluble, and likely comprises only alpha-glycosidic linkages. The intrinsic viscosity and branching of the glucan product (analyzed as described in General Methods) are listed in Table 5 below.

Example 9

Production of GTF Enzyme Lacking Sequence Motifs 1a and 2

A nucleotide sequence encoding a polypeptide similar to the 7527 GTF of SEQ ID NO:65, but with deletion of Motifs 1a and 2 (Example 4), was synthesized using codons optimized for expression in *E. coli* (DNA 2.0, Menlo Park Calif.). The nucleic acid product (SEQ ID NO:90), encoding GTF protein 7527-NT-dIS1a,2 (SEQ ID NO:91), was subcloned into pJexpress404® to generate the plasmid identified as pMP104. Plasmid pMP104 was used to transform *E.* coli TOP10 cells to generate the strain identified as TOP10/pMP104. It is noted that a GTF catalytic domain sequence is located at amino acid positions 54-911 (approximate) of SEQ ID NO:91.

Production of 7527-NT-dIS1a,2 (SEQ ID NO:91) with *E. coli* and production of glucan polymer using this enzyme were performed as described above (General Methods). The glucan product is insoluble, and likely comprises only alpha-glycosidic linkages. The intrinsic viscosity and branching of the glucan product (analyzed as described in General Methods) are listed in Table 5 below.

Example 10

Production of GTF Enzyme Lacking Sequence Motifs 1a and 3a

A nucleotide sequence encoding a polypeptide similar to the 7527 GTF of SEQ ID NO:65, but with deletion of Motifs 1a and 3a (Example 4), was synthesized using codons optimized for expression in *E. coli* (DNA 2.0, Menlo Park Calif.). The nucleic acid product (SEQ ID NO:92), encoding GTF protein 7527-NT-dIS1a,3a (SEQ ID NO:93), was subcloned into pJexpress404® to generate the plasmid identified as pMP105. Plasmid pMP105 was used to transform *E. coli* TOP10 cells to generate the strain identified as TOP10/pMP105. It is noted that a GTF catalytic domain sequence is located at amino acid positions 54-919 (approximate) of SEQ ID NO:93.

Production of 7527-NT-dIS1a,3a (SEQ ID NO:93) with *E. coli* and production of glucan polymer using this enzyme were performed as described above (General Methods). The intrinsic viscosity and branching of the glucan product (analyzed as described in General Methods) are listed in Table 5 below.

Example 11

Production of GTF Enzyme Lacking Sequence Motifs 2 and 3a

A nucleotide sequence encoding a polypeptide similar to the 7527 GTF of SEQ ID NO:65, but with deletion of Motifs 2 and 3a (Example 4), was synthesized using codons optimized for expression in *E. coli* (DNA 2.0, Menlo Park Calif.). The nucleic acid product (SEQ ID NO:94), encoding GTF protein 7527-NT-dIS2,3a (SEQ ID NO:95), was subcloned into pJexpress404® to generate the plasmid identified as pMP106. Plasmid pMP106 was used to transform *E. coli* TOP10 cells to generate the strain identified as TOP10/pMP106. It is noted that a GTF catalytic domain sequence is located at amino acid positions 54-905 (approximate) of SEQ ID NO:95.

Production of 7527-NT-dIS2,3a (SEQ ID NO:95) with *E. coli* and production of glucan polymer using this enzyme were performed as described above (General Methods). The intrinsic viscosity and branching of the glucan product (analyzed as described in General Methods) are listed in Table 5 below.

Example 12

Production of GTF Enzyme Lacking Sequence Motifs 1a, 2 and 3a

A nucleotide sequence encoding a polypeptide similar to the 7527 GTF of SEQ ID NO:65, but with deletion of Motifs 1a, 2 and 3a (Example 4), was synthesized using codons optimized for expression in *E. coli* (DNA 2.0, Menlo Park Calif.). The nucleic acid product (SEQ ID NO:96), encoding GTF protein 7527-NT-dIS1a,2,3a (SEQ ID NO:97), was subcloned into pJexpress404® to generate the plasmid identified as pMP107. Plasmid pMP107 was used to transform *E. coli* TOP10 cells to generate the strain identified as TOP10/pMP107. It is noted that a GTF catalytic domain sequence is located at amino acid positions 54-889 (approximate) of SEQ ID NO:97.

Production of 7527-NT-dIS1a,2,3a (SEQ ID NO:97) with *E. coli* and production of glucan polymer using this enzyme were performed as described above (General Methods). The intrinsic viscosity and branching of the glucan product (analyzed as described in General Methods) are listed in Table 5 below.

Example 13

Analysis of Intrinsic Viscosity and Branching of Glucan Products Synthesized by GTF Enzymes This Example describes measuring the intrinsic viscosity (IV) and branching (g') of glucan polymer synthesized by each of the deletion-containing GTF enzymes prepared in Examples 6-12. These measurements were compared to those obtained with glucan polymer produced by the 7527 GTF of SEQ ID NO:65, which does not have any internal deletions of Motifs 1a, 2 and/or 3a.

It is noted that the glucan polymer synthesized by 7527 GTF, poly alpha-1,3-glucan, has 100% alpha-1,3 linkages and is thus linear (see Table 4, for example).

The intrinsic viscosity and branching of glucan polymer samples produced by deletion-containing versions of 7527 GTF were analyzed as described in the General Methods, and are shown in Table 5 below. Glucan polymer produced by non-deleted 7527 GTF (control), which is listed as "7527-NT" in Table 5, was also analyzed.

TABLE 5

Intrinsic Viscosity (IV) and Branching Index (g') of Glucan Polymer Produced by Various GTF Enzymes

| Enzyme ID | SEQ ID NO | Missing Motif(s) | Glucan Product Measurement | |
|---|---|---|---|---|
| | | | IV | g' |
| 7527-NT | 65 | N/A | 206 | 1.000 |
| 7527-NT-dIS1a | 85 | 1a | 94 | 0.410 |
| 7527-NT-dIS2 | 87 | 2 | 33 | 0.231 |
| 7527-NT-dIS3a | 89 | 3a | 28 | 0.268 |
| 7527-NT-dIS1a, 2 | 91 | 1a and 2 | 21 | 0.261 |
| 7527-NT-dIS1a, 3a | 93 | 1a and 3a | 18 | 0.215 |
| 7527-NT-dIS2, 3a | 95 | 2 and 3a | 19 | 0.256 |
| 7527-NT-dIS1a, 2, 3a | 97 | 1a, 2 and 3a | 22 | 0.242 |

As shown in Table 5, glucan produced by each GTF enzyme missing at least one of Motifs 1a (motif i), 2 (motif ii), or 3a (motif iii) had decreased intrinsic viscosity (IV) and branching index (g'), as compared to glucan produced by the corresponding control GTF (7527-NT) having each of these motifs. Since reductions in either IV and/or g' indicate increased polymer branching, these results demonstrate that each of Motifs 1a, 2 and 3a may be essential for certain GTF enzymes—ones that naturally contain each of these motifs—to produce linear alpha-1,3-glucan polymer.

This observation was not expected, given that some GTF enzymes that produce linear product do not contain any of Motifs 1a, 2, or 3 a. For example, each of GTFs 5926, 0427, 0874, and 1724 produce poly alpha-1,3-glucan with 100% alpha-1,3 linkages (which is linear) (Table 4), despite not having any of these motifs. Indeed, since there appeared to be a correlation between the presence of Motifs 1a, 2 and 3a with increased glucan product molecular weight (see Example 4), it might have been more reasonable to have expected that Motif 1a, 2, and/or 3a removal would reduce glucan product molecular weight (instead of having an effect on branching).

Thus, GTF amino acid Motifs 1a, 2 and 3a play a role in production of linear poly alpha-1,3-glucan by those GTF enzymes that contain these motifs

Example 14

GTF Catalytic Domain Activity

This Example describes testing catalytic domain sequences of certain GTFs for the ability to produce insoluble poly alpha-1,3-glucan. Specifically, catalytic domain sequences of GTFs 7527 (SEQ ID NO:65) and 5926 (SEQ ID NO:14) were tested for activity.

A GTF catalytic domain sequence having amino acid residues 54-957 of SEQ ID NO:65 was prepared using the heterologous expression techniques described above. Briefly, a DNA sequence (codon-optimized for expression in *E. coli*) encoding a methionine at the first amino acid position followed by amino acid residues 54-957 of SEQ ID NO:65 was prepared and used to express this catalytic domain sequence. This protein, compared to the amino acid sequence identified in GENBANK under GI number 47527 (SEQ ID NO:60), is truncated by 230 amino acids at the N-terminus and 384 amino acids at the C-terminus.

A GTF catalytic domain sequence having amino acid residues 57-906 of SEQ ID NO:14 was prepared using the heterologous expression techniques described above. Briefly, a DNA sequence (codon-optimized for expression in *E. coli*) encoding a methionine at the first amino acid position followed by amino acid residues 57-906 of SEQ ID NO:14 was prepared and used to express this catalytic domain sequence. This protein, compared to the amino acid sequence identified in GENBANK under GI number 167735926 (SEQ ID NO:83), is truncated by 199 amino acids at the N-terminus and 417 amino acids at the C-terminus.

The above procedures were followed to prepare reaction solutions containing either of these GTF catalytic domain sequences. The reactions were performed at 25° C. and the alpha-1,3-glucan produced in each reaction was analyzed for $DP_w$. The results are provided in Table 6.

TABLE 6

Alpha-1,3-Glucan Polymer Produced by Gtf Enzyme Catalytic Domains

| Catalytic Domain Sequence | $DP_w$ | Initial sucrose (g/L) | % Sucrose consumption |
|---|---|---|---|
| 5926 | 108 | 150 | 100 |
| 7527 | 495 | 142 | 94 |

As shown in Table 6, catalytic domain sequences of GTF 7527 (residues 54-957 of SEQ ID NO:65) and GTF 5926 (residues 57-906 of SEQ ID NO:14) were able to catalyze production of poly alpha-1,3-glucan. The molecular weight of the poly alpha-1,3-glucan produced by each of these catalytic domain sequences generally corresponded with the molecular weight of the product produced by their counterparts containing both the catalytic domain and glucan binding domain (refer to activity of SEQ ID NOs:65 and 14 in Table 4, $DP_w$ 150).

Thus, the catalytic domain of a glucosyltransferase enzyme can be used to produce insoluble poly alpha-1,3-glucan in a reaction solution.

SEQUENCE LISTING (97 sequences)

SEQ ID NO: 1 - DNA, 4308 bp, Streptococcus sobrinus
atggttgacggcaaatactactattatgatcaggacggtaacgtaaagaagaatttcgcggtgagcgttggtgacaaaatctactacttcgatgaaactggtgcatataaggataccagcaaagtggacgccgacaagagcagcagcgcggttagccaaaacgcgaccatctttgcggcgaataaccgtgcgtacagcacctctgcaaagaattttgaagcggtggataactacctgaccgcagacagctggtatcgtccgaaatccatcctgaaggacggcaaaacctggaccgagagcggtaaggatgatttccgtccactgctgatggcatggtggcctgacaccgaaactaagcgcaactacgtgaactatatgaataaagtggtcggtattgacaagacgtacactgcggaaacgtcgcaagcggatttgaccgcagcggcggagctggttcaagcgcgtatcgagcagaagattaccagcgaaaacaacaccaaatggctgcgcgaagcaatctccgcgttcgttaagacgcagcctcagtggaacggcgagtccgaaaagccgtatgacgatcacttgcagaacggtgcgctgctgtttgataaccaaaccgacctgacgccagacacccaaagcaattaccgtttgctgaaccgtaccccgaccaatcagactggtagcctggatagccgttttacgtataatccgaatgacccgttgggcggctacgatttcttgctggcgaacgacgttgacaatagcaatccggtcgtccaggctgaacagttgaactggctgcattatctgctgaactttggctctatttacgctaacgatgccgacgccaattttgacagcattcgcgttgatgccgtcgataatgtcgatgctgatctgctgcaaatcagcagcgattacctgaaagcagcgtatggcatcgacaagaataacaagaatgcgaacaaccatgttagcatcgtcgaagcgtggagcgacaatgataccccgtatttgcacgacgatggcgataatctgatgaacatggacaacaaatttcgcctgtccatgctgtggagcctggcaaagccgctggacaaacgtagcggtttgaacccgctgattcacaatagcctggtggaccgcgaggtggacgatcgtgaagtggaaaccgtgccgtcctacagctttgctcgtgcacatgatagcgaggtgcaggacatcatccgtgacattatcaaggctgagattaacccaaatagctttggttatagcttcactcaagaagagatcgagcaagcctttaagatttacaacgaggatttgaagaaaacggacaagaaatacacccactacaatgtgccgctgagctacaccctgctgctgaccaacaagggcagcatcccgcgtgtgtactatggtgatatgttcaccgatgatggccaatacatggcaaacaagaccgtcaactacgacgcaatcgagagcctgctgaaagcccgtatgaaatatgtcagcggtggccaagcaatgcagaactatcaaattggtaatggcgagattttgaccagcgtgcgctatggtaaaggtgccctgaagcagagcgataagggtgacgcgacgacgcgcactagcggtgttggcgtggttatgggtaatcagccgaacttctccctggacggtaaagttgtggccctgaatatgggtgcggcccatgcgaatcaagaataccgtgcactgatggtcagcactaaagacggtgtggcaacttacgcaaccgatgctgacgcatccaaagcgggcctggtcaagcgtaccgacgagaacggctacctgtacttcctgaatgatgatctgaagggcgtcgcgaaccctcaggtttccggcttcttgcaagtgtgggttccagttggtgccgccgatgaccaggacattcgcgtcgccgccagcgacacggcgagcacggatggtaaaagcctgcatcaagatgcggcgatggacagccgcgtcatgtttgagggtttcagcaattttcaatccttcgcgaccaaagaagaagaatacacgaatgttgttatcgcgaacaatgtcgataagttcgttagctggggtatcaccgattttgaaatggctccgcagtatgttagcagcaccgacggtcagttcttggacagcgtcatccagaatggctatgcgtttactgatcgctatgatctgggtatgtccaaggcgaacaagtatggcacggcagaccaactggttaaggcaatcaaagccctgcacgctaaaggcctgaaagttatggcggactgggtcccggatcaaatgtacacctttccaaaacaggaagttgtgaccgttacccgcaccgacaaattcggtaaaccgatcgccggctctcaaatcaatcacagcttgtatgtgaccgacaccaaatccagcggcgacgactaccaagcgaagtacggcggtgccttcctggatgaactgaaagaaaagtacccggaactgttcacgaaaaagcaaattagcacgggccaagcgattgatccgagcgtgaaaatcaagcagtggagcgcaaaatacttcaatggttcgaatatcctgggtcgcggtgcggactatgtgctgagcgaccaggtcagcaataagtatttcaacgtggcgagcgacaccttgttcctgccgtccagcctgctgggcaaggtcgtggagagcggcattcgttacgacggcaagggttacatctacaacagctccgcgaccggcgatcaggtcaaagcgtctttcattacggaagccggtaacctgtattacttcggcaaagacggttacatggttactggtgcccagacgattaatggcgccaactacttcttcctggaaaacggtacggcactgcgtaatacgatttacaccgatgctcaaggtaatagccactattacgcgaatgatggcaaacgctatgaaaatggctatcaacagttcggtaacgattggcgctactttaaagatggtaacatggcagtcggcctgaccacggttgatggcaacgtgcaatactttgacaaagacggcgtccaggcaaaggataagattatcgtcacccgtgatggcaaggtccgttacttcgatcagcacaacggtaacgcggcgaccaacacgttcattgctgataaaactggccattggtattacctgggtaaagatggcgtcgcggtgactggcgcccagaccgtcggcaaacaaaaactgtacttcgaggccaacggtcaacaagttaaaggtgactttgttacgtccgatgagggcaaactgtatttctatgacgttgattctggtgacatgtggacggacaccttcatcgaggataaggcgggcaactggttctatttgggcaaggatggtgcggcagttacgggtgcccaaacgattcgcggtcagaagctgtacttcaaggccaatggtcaacaggtcaagggtgacattgttaagggcaccgacggtaaaatccgctactatgatgcaaaatccggtgaacaggtgttcaacaaaacggtgaaagctgcggatggcaaaacgtatgttatcggtaatgatggtgtcgcggtggaccctagcgtggttaaaggtcaaacctttaaggacgcttcgggcgctctgcgtttctacaacttgaagggtcaactggtcactggcagcggctggtatgaaaccgcgaaccatgactgggtttacattcagtccggcaaggcactgaccggcgaacagaccattaacggtcaacacctgtatttcaaagaagatggtcaccaagtcaagggtcagttggtcacgggcaccgatggtaaagtgcgttactatgacgccaacagcggtgaccaagcattcaacaagagcgtcactgtgaatggtaaaacctattactttggcaacgatggtacggcgcagactgctggcaacccgaagggtcagacgttcaaggatggctccgacatccgtttttactctatggaaggccaactggtgaccggctcgggttggtacgagaacgcgcaaggccagtggctgtatgtgaaaaacggtaaggtgctgactggtctgcaaaccgttggcagccagcgtgtttacttcgacgagaatggtattcaggccaagggcaaagcagtgcgtaccagcgatggcaaaattcgttatttcgacgaaaacagcggcagcatgatcacgaatcaatggaagttcgtctatggtcagtattactactttggtaacgacggtgcacgtatttaccgtggttggaactaa

SEQ ID NO: 2 - protein, 1435 aa, Streptococcus sobrinus
MVDGKYYYYDQDGNVKKNFAVSVGDKIYYFDETGAYKDTSKVDADKSSSAVSQNATIFAANNRAYSTSAKNFEAVDNYLTADSWYRPKSILKDGKTWTESGKDDFRPLLMAWWPDTETKRNYVNYMNKVVGIDKTYTAETSQADLTAAAELVQARIEQKITSENNTKWLREAISAFVKTQPQWNGESEKPYDDHLQNGALLFDNQTDLTPDTQSNYRLLNRTPTNQTGSLDSRFTYNPNDPLGGYDFLLANDVDNSNPVVQAEQLNWLHYLLNFGSIYANDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIEQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAATNTFIADKTGHWYYLGKDGVAVTGAQTVGKQKLYFEANGQQVKGDFVTSDEGKLYFYDVDSGDMWTDTFIEDKAGNWFYLGKDGAAVTGAQTIRGQKLYFKANGQQVKGDIVKGTDGKIRYYDAKSGEQVFNKTVKAADGKTYVIGNDGVAVDPSVVKGQTFKDASGALRFYNLKGQLVTGSGWYETANHDWVYIQSGKALTGEQTINGQHLYFKEDGHQVKGQLVTGTDGKVRYYDANSGDQAFNKSVTVNGKTYYFGNDGTAQTAGNPKGQTFKDGSDIRFYSMEGQLVTGSGWYENAQGQWLYVKNGKVLTGLQTVGSQRVYFDENGIQAKGKAVRTSDGKIRYFDENSGSMITNQWKFVYGQYYYFGNDGARIYRGWN

SEQ ID NO: 3 - DNA, 4026 bp, Streptococcus salivarius SK126
atgatcgacggcaaatactattatgttaatgaggacggtagccacaaagaaaactttgcgattacggttaatggtcaactgctgtatttcggtaaggacggcgcactgacctctagcagcacttacagctttaccccaggtacgacgaacatcgtggatggcttttctatcaacaaccgcgcgtatgactccagcgaagcgtcctttgaactgattgatggctacttgactgccgactcctggtatcgtccggcttccatcatcaaggacggtgtcacgtggcaggccagcaccgcagaggactttcgcccgctgctgatggcgtggtggccaaacgtggatacccaggtgaactatctgaactacatgtctaaagtgtttaacctggacgcaaagtatagcagcaccgataaacaagagactctgaaggttgcagctaaggatattcagattaagatcgagcagaaaattcaggcggagaaaagcacccaatggctgcgcgaaacgatcagcgcttttgtgaaaacccaaccacagtggaacaaagagactgagaattactcgaaaggtggtggtgaggatcatctgcaaggcggtgcactgctgtacgtgaatgatagccgtaccccgtgggcaaatagcgattatcgccgcctgaaccgcaccgctaccaatcaaacgggtacgattgacaagtccattctggacgagcagagcgacccaaatcacatgggcggtttcgacttcctgctggcgaatgatgttgacctgtccaacccggttgtgcaggcagagcagctgaaccagattcactacttgatgaattggggctctatcgtgatgggtgacaaagacgcaaactttgatggtatccgtgtcgatgcagttgacaacgtcgatgccgacatgctgcaactgtataccaactacttccgtgaatactacggtgttaacaaaagcgaagcgaacgcactggcgcacattagcgttttggaagcgtggagcttgaatgataatcactacaacgacaaaaccgatggtgcagcattggcgatggagaataagcagcgtctggcgctgctgtttagcctggctaaaccgattaaagagcgcaccccggcagtgagcccgctgtataacaacaccttcaatacgacccaacgcgatgagaaaaccgactggatcaataaagacggttctaaggcctataacgaggatggtactgtgaagcagagcaccattggtaagtacaatgaaaaatatggtgatgcatcgggcaattatgtgttcatccgtgcccatgataacaatgtccaagacatcattgcggagatcattaagaaagaaatcaacccgaaaagcgatggtttcaccatcactgacgccgaaatgaaacaagcgttcgagatttacaataaggacatgctgagcagcgacaagaagtacaccctgaataacatcccggcagcttatgccgtgatgttgcagaacatggaaacgattacccgtgtctattatggtgacctgtacaccgacgacggccactacatggaaaccaagtccccgtattacgacaccatcgttaacctgatgaaaagccgtatcaagtacgtcagcggtggccaggcccaacgtagctactggctgccgaccgacggcaagatggacaatagcgacgttgagctgtatcgcaccaacgaagtgtataccagcgtccgttacggtaaagacattatgaccgcgaacgataccgagggtagcaagtacagccgcaccagcggccaggtcaccctggttgcaaacaacccgaagctgaccctggaccagagcgcgaagctgaatgtggaaatgggtaagattcacgcgaatcagaaataccgtgccctgattgtgggcacggctgacggtatcaagaatttcaccagcgacgcagatgctatcgcggcaggctacgtgaaagaaaccgactccaatggcgttctgacttttggcgctaatgacatcaaaggttatgaaaccttcgacatgtccggctttgttgctgtttgggtgccggtcggcgcgagcgatgatcaggacattcgtgtcgctcctagcactgaggccaagaaagagggtgaattgaccctgaaagcgaccgaagcatacgattcccagctgatctatgaaggttttagcaattttcaaaccatcccggatggtagcgacccgagcgtgtacaccaatcgcaagatcgcagagaacgtggacctgttcaagtcctggggtgttacctcgtttgaaatggcaccgcagttcgtttccgcagatgatggcacttttctggactctgtgatccaaaacggctatgcgtttgccgatcgttacgatttggcgatgagcaagaacaacaaatacggcagcaaagaggacttgcgtgacgcgctgaaagccctgcataaagcaggcatccaggcgattgcagactgggtcccggaccagatttatcagttgccgggcaaagaagtggtcacggcgactcgcaccgacggcgcaggccgtaaaatcgcggacgcgatcattgatcatagcctgtacgttgcgaacactaagagcagcggcaaagattaccaggcgaagtacggtggtgagttcttggcggagctgaaggccaagtacccggagatgttcaaagtgaacatgatttctaccggcaaaccgattgatgacagcgtcaaactgaaacagtggaaagcagaatactttaacggcaccaacgtcttggagcgcggtgtgggttatgtcctgagcgatgaagccacgggtaaatactttaccgtcacgaaggatggcaacttcattccgttgcagctgacgggtaatgagaaagtcgtgaccggctttagcaatgatggcaaaggtatcacctacttcggtacgagcggcactcaagcgaaatctgcgttcgttacgttcaatggtaatacttactattttgacgctcgtggtcacatggttacgaacggcgagtattcgccgaacggtaaggatgtttaccgtttcctgccgaatggtattatgctgtctaacgctttttacgttgatgcaaatggtaacacgtacctgtacaacagcaagggccaaatgtacaaaggcggttacaccaaatttgacgttaccgaaacggacaaagatggtaaggaaagcaaggtggtgaagtttcgttactttacgaacgaaggtgtcatggcaaaaggcgttaccgtgattgacggcttcacgcaatactttggtgaagatggtttccaagcgaaagacaagctggtcacgttcaagggcaagacgtactacttcgatgcacacaccggcaatgcgatcaaggacacctggcgtaatatcaatggcaagtggtatcatttcgacgcgaacggcgttgcagcgaccggcgctcaggtcatcaatggccaaaaactgtatttcaacgaggacggcagccaagtgaaaggcggtgttgtcaaaaacgcggacggtacgtattctaaatacaaagagggttctggtgaactggttaccaacgagttcttcacgacggatggcaatgtttggtactacgcaggcgcgaatggcaagaccgttacgggtgcccaggtgattaacggccaacacctgtacttcaatgcggacggttcgcaagtgaagggcggtgtggtcaagaacgcggatggcacctatagcaaatatgatgcgtctaccggcgaacgcctgaccaatgagtttttcaccacgggtgataacaactggtactacattggcgcaaacggcaagagcgtgacgggcgaggtcaagatcggtgacgatacctatttctttgccaaagatggcaagcaagttaagggtcaaactgtcagcgcgggtaacggtcgtattagctactactatggtgatagcggtaagcgtgcggtgagcacttggatcgaaatccaaccgggtgtttatgtctacttcgacaagaacggcattgcctatccgcctcgtgtgctgaattaa

SEQ ID NO: 4 - protein, 1341 aa, Streptococcus salivarius SK126 [sequence omitted]

SEQ ID NO: 5 - DNA, 3744 bp, Streptococcus salivarius
atgccaagccacattaagaccatcaacggcaaacaatactacgtggaggatgacggtacgattcgcaagaattacgtcctggagcgtatcggtggcagccaatactttaatgcagaaaccggtgaactgtctaatcagaaagagtatcgtttcgacaaaaatggtggtactggtagcagcgcggacagcacgaacaccaacgtgactgtgaacggtgacaaaaacgcattttacggtaccacggacaaagacattgagctggtcgacggctatttcaccgcgaacacctggtatcgcccgaaagaaatcctgaaagacggcaaagaatggaccgccagcacggagaacgataaacgcccgctgctgaccgtctggtggcctagcaaagcaatccaggcgtcttatctgaactacatgaaagagcaaggcctgggtaccaaccaaacgtacacgagcttctccagccaaacccaaatggatcaagcagccctggaagtgcaaaagcgtattgaagagcgcatcgcacgcgagggcaataccgactggctgcgcacgaccatcaagaacttcgtgaaaacccaaccgggttggaacagcacctctgaaaatctggacaataatgatcatctgcaaggtggcgccctgctgtacaataacgactcccgcacgagccacgcgaacagcgactatcgcctgctgaatcgtacgccgaccagccagaccggcaaacacaatccgaaatacaccaaagataccagcaatggtggtttcgaatttctgctggcgaacgacatcgataactctaatccggcggttcaagcagagcaactgaactggctgcattacattatgaacatcggtaccatcacgggcggttctgaggatgaaaacttcgacggcgttcgtgttgacgctgtggataatgtgaatgcggatctgctgcaaatcgcgagcgactatttcaaagcaaaatacggtgctgatcaaagccaagatcaggcgatcaaacacttgagcatcctggaagcgtggtcccataacgacgcctactataacgaagataccaaaggcgcgcagttgccgatggatgatccgatgcacctggctctggtctactcgctgctgcgtccgatcggcaatcgcagcggtgtggaaccgctgatttccaacagcctgaatgaccgtagcgagtccggtaagaacagcaaacgtatggcgaactacgcgttcgtacgcgcgcatgatagcgaggtgcaatcgattattggccagatcatcaaaaacgagatcaatccgcaaagcaccggtaatacgttcaccctggatgagatgaagaaagcgtttgagatttacaacaaggatatgcgtagcgcgaataagcagtatacgcagtacaacatcccgagcgcgtatgcgttgatgctgacccacaaggataccgttccgcgtgtgtattacggtgatatgtatacggacgacggtcagtacatggcgcaaaagagcccatactatgatgcgatcgaaacgctgctgaaaggtcgcatccgctatgccgcaggtggtcaggacatgaaggtcaactatattggttacggtaacactaacggctgggatgctgcgggcgtgctgaccagcgtacgttatggcacgggcgcaaatagcgccagcgatacgggtaccgccgaaacgcgtaatcaaggtatggcagtgattgttagcaaccaaccggcgctgcgtctgactagcaatttgaccattaacatgggtgccgcacaccgtaatcaggcttaccgtccgctgctgctgacgaccaacgatggcgtcgcgacctatttgaacgatagcgatgcgaatggtatcgttaagtacaccgacggtaatggtaatctgaccttctccgcaaacgagattcgtggcatccgtaacccgcaagttgatggctatctggccgtctgggttccggtaggtgcgtcggagaatcaggatgttcgtgtggcgccgagcaaagagaagaacagctccggtctggtttacgagagcaatgctgccctggatagccaagttatctacgaaggcttcagcaacttccaggacttcgttcagaatccgagccagtataccaacaaaaagattgcagagaatgcaaatttgttcaaatcctggggtattaccagctttgaatttgcgccgcagtacgtgagctcggatgatggtagcttcctggacagcgttattcagaacggttatgcgtttacggaccgctacgacattggtatgagcaaagacaacaaatatggttcgctggcggatttgaaggcagcactgaagagcttgcatgccgttggtattagcgcaatcgcggattgggttcctgatcagatctacaatctgccaggcgacgaggtcgtcaccgcaacccgcgttaacaactacggcgaaaccaaagatggtgcaatcattgatcactctttgtacgcggccaaaacccgtacttttggtaacgactaccagggtaagtatggtggtgcgttcctggacgagctgaaacgtctgtatccgcagatctttgaccgcgttcagatttctaccggtaagcgcatgaccacggacgagaagatcacccaatggtctgcaaagtatatgaacggtacgaacatcttggaccgtggctctgaatacgttttgaagaatggtctgaatggttactatggcaccaatggtggcaaagtttcgctgccgaaagttgtgggtagcaatcaaagcacgaatggcgacaatcaaaacggcgacggtagcggcaagtttgaaaagcgtctgttcagcgtgcgttaccgttataacaatggccagtacgcgaaaaatgcctttatcaaagataacgacggcaatgtttactatttcgacaatagcggtcgtatggctgtcggtgagaaaacgattgacggcaagcagtacttcttcctggctaatggcgttcagctgcgtgacggctaccgtcaaaatcgtcgcggtcaggtgttttactacgaccagaatggtgtgctgaacgcaaacggtaaacaagacccgaagcctgacaacaataacaatgcgagcggccgtaatcaattcgtccagatcggtaacaacgtgtgggcgtattatgatggcaatggtaaacgtgtcaccggtcaccagaacatcaacggtcaggagttgtttttcgataacaacggtgtccaggttaagggtcgtacggtgaatgagaacggtgcaattcgctactatgacgcgaatagcggtgagatggcacgcaatcgtttcgcggagattgaaccgggcgtctgggcatactttaacaatgacggcaccgcagtgaagggttctcagaatatcaatggtcaagacctgtacttcgaccagaacggtcgtcaggtcaagggtgcgctggccaatgttgatggcaacctgcgctattacgacgttaacagcggtgagctgtaccgtaatcgtttccacgaaatcgacggcagctggtattactttgatggtaacggtaatgcggtgaagggtatggtcaatatcaacggccaaaatctgttgtttgacaataacggcaaacagattaagggtcatctggtccgcgtcaacggcgtcgtgcgctattttgatccgaactctggtgaaatggcggttaatcgttgggttgaggtgagcccaggttggtgggtttactttgacggtgaaggtcgtggtcagatctaa

SEQ ID NO: 6 - protein, 1247 aa, Streptococcus salivarius
MPSHIKTINGKQYYVEDDGTIRKNYVLERIGGSQYFNAETGELSNQKEYRFDKNGGTGSSADSTNTNVTVNGDKNAFYGTTDKDIELVDGYFTANTWYRPKEILKDGKEWTASTENDKRPLLTVWWPSKAIQASYLNYMKEQGLGTNQTYTSFSSQTQMDQAALEVQKRIEERIAREGNTDWLRTTIKNFVKTQPGWNSTSENLDNNDHLQGGALLYNNDSRTSHANSDYRLLNRTPTSQTGKHNPKYTKDTSNGGFEFLLANDIDNSNPAVQAEQLNWLHYIMNIGTITGGSEDENFDGVRVDAVDNVNADLLQIASDYFKAKYGADQSQDQAIKHLSILEAWSHNDAYYNEDTKGAQLPMDDPMHLALVYSLLRPIGNRSGVEPLISNSLNDRSESGKNSKRMANYAFVRAHDSEVQSIIGQIIKNEINPQSTGNTFTLDEMKKAFEIYNKDMRSANKQYTQYNIPSAYALMLTHKDTVPRVYYGDMYTDDGQYMAQKSPYYDAIETLLKGRIRYAAGGQDMKVNYIGYGNTNGWDAAGVLTSVRYGTGANSASDTGTAETRNQGMAVIVSNQPALRLTSNLTINMGAAHRNQAYRPLLLTTNDGVATYLNDSDANGIVKYTDGNGNLTFSANEIRGIRNPQVDGYLAVWVPVGASENQDVRVAPSKEKNSSGLVYESNAALDSQVIYEGFSNFQDFVQNPSQYTNKKIAENANLFKSWGITSFEFAPQYVSSDDGSFLDSVIQNGYAFTDRYDIGMSKDNKYGSLADLKAALKSLHAVGISAIADWVPDQIYNLPGDEVVTATRVNNYGETKDGAIIDHSLYAAKTRTFGNDYQGKYGGAFLDELKRLYPQIFDRVQISTGKRMTTDEKITQWSAKYMNGTNILDRGSEYVLKNGLNGYYGTNGGKVSLPKVVGSNQSTNGDNQNGDGSGKFEKRLFSVRYRYNNGQYAKNAFIKDNDGNVYYFDNSGRMAVGEKTIDGKQYFFLANGVQLRDGYRQNRRGQVFYYDQNGVLNANGKQDPKPDNNNNASGRNQFVQIGNNVWAYYDGNGKRVTGHQNINGQELFFDNNGVQVKGRTVNENGAIRYYDANSGEMARNRFAEIEPGVWAYFNNDGTAVKGSQNINGQDLYFDQNGRQVKGALANVDGNLRYYDVNSGELYRNRFHEIDGSWYYFDGNGNAVKGMVNINGQNLLFDNNGKQIKGHLVRVNGVVRYFDPNSGEMAVNRWVEVSPGWWVYFDGEGRGQI

SEQ ID NO: 7 - DNA, 4434 bp, Streptococcus salivarius
atggacgaaacgcaggataagaccgtgacgcagagcaacagcggcaccaccgcttccctggtcactagccctgaagccacgaaagaggcggacaaacgcacgaacactaaagaggccgacgttctgacgcctgcaaaagaaacgaacgcagtcgagactgcgaccaccactaacacccaggcgacggcggaggccgccacgaccgcgaccaccgcggacgtcgcggtggctgcggtgccgaacaaagaagcggtcgttaccacggatgctccggcggtcacgaccgagaaagcggaagaacagccggctaccgttaaagcagaagtcgtcaatacggaagtgaaagcgccggaagcggctctgaaagacagcgaggttgaggcagcgctgagcctgaagaacatcaagaacattgatggcaagtattactatgttaatgaggatggcagccacaaagagaatttcgctattaccgtgaatggccagctgctgtactttggtaaagacggtgcgctgacgtcctctagcacgtattcttttaccccaggcactaccaatatcgtggacggttttagcattaacaaccgcgcttacgacagcagcgaggcgagctttgagctgatcgacggttacttgaccgcagacagctggtatcgtccggctagcatcatcaaagatggtgttacgtggcaagcgtccaccgccgaggattttcgtccgctgctgatggcatggtggccgaatgtggatacgcaggtgaactatttgaattacatgtccaaagttttcaacctggacgcgaaatactctagcaccgacaaacaggaaaccctgaaagtggcagcaaaagacattcaaatcaagattgaacaaaagattcaagcggagaagagcacgcagtggctgcgtgaaactatcagcgcctttgtgaaaacccagccgcagtggaacaaagaaaccgagaattacagcaagggtggtggtgaggaccacctgcaaggtggcgcactgctgtatgttaacgacagccgtaccccttgggcgaatagcgattaccgtcgtctgaatcgcaccgcaaccaatcagacgggcacgatcgataagtctattctggacgagcagtctgacccaaaccacatgggcggtttcgactttctgctggcgaacgacgtcgacctgagcaatccggtcgtgcaggctgagcagctgaatcaaatccactatctgatgaattggggttccattgtgatgggtgacaaggatgcgaactttgacggcattcgtgtcgatgcagttgacaacgtggacgcggacatgttgcaactgtataccaattacttccgtgagtactacggtgtgaacaagagcgaagctaacgcactggctcacatcagcgttctggaggcgtggagcctgaatgataatcattacaatgacaagaccgatggtgcggcactggcaatggagaataagcaacgtctggcgctgttgttttcgttggcgaaaccgatcaaagagcgtaccccggcagtgagcccgctgtataacaacaccttcaataccacccagcgtgatgaaaagaccgattggattaacaaagacggtagcaaggcttacaacgaagatggcacggtcaaacaatcgaccatcggtaagtacaacgagaaatacggtgacgcatccggtaactacgttttcatccgtgcccacgataacaacgtccaggacatcatcgccgagatcatcaagaaagagatcaacccgaaaagcgacggcttcaccatcaccgacgccgaaatgaagcaagcctttgaaatctataacaaagatatgctgtcgagcgacaaaaagtataccctgaataacattccggcagcgtatgccgtgatgttgcagaatatggaaacgattacccgcgtctattacggtgatctgtatacggacgacggtcactacatggaaaccaaatctccgtattacgataccatcgtgaatttgatgaagagccgtatcaagtatgtttcgggtggccaggcgcaacgtagctattggctgccgaccgacggtaagatggacaatagcgacgttgagctgtaccgcacgaatgaggtttacacgagcgtgcgctatggtaaggatatcatgaccgctaatgataccgaaggctctaagtattcccgcaccagcggccaagtcaccttggtcgcgaacaatccgaagctgaatctggaccaaagcgccaagttgaatgtggagatgggcaaaatccatgcgaatcagaagtatcgcgcactgattgtcggcactgcggacggcattaagaactttacttccgacgcggacgccattgcagcgggttatgtgaaagaaaccgatagcaacggcgtgctgaccttcggtgctaacgacattaagggctacgaaacgtttgatatgagcggtttcgtggcggtgtgggttccggtgggtgcatctgacaatcaggacattcgtgttgcgccgagcaccgaggcaaagaaagaaggtgagctgaccttgaaggcgacggaagcgtatgatagccagctgatttacgaaggctttagcaatttccagacgatcccagatggcagcgatccgtccgtgtatacgaaccgcaagattgcggagaacgtggatctgttcaaaagctggggtgtcaccagctttgagatggcaccgcaatttgtctcggcggatgatggcacctttctggatagcgttattcagaatggctacgccttcgccgaccgttatgacctggccatgtccaagaacaacaagtatggtagcaaagaggacctgcgtgatgcactgaaagcactgcataaggcgggtattcaagctatcgcagactgggttccagaccagatctaccagctgccgggcaaagaagttgtcaccgccacccgtacggatggtgctggccgtaagatcgcagacgcgattatcgaccattctctgtatgttgcaaacagcaaaagcagcggcaaagattatcaagcaaagtacggtggcgagttcctggccgagctgaaagccaaatacccggaaatgttcaaagttaacatgattagcacgggtaagccgattgatgactccgtgaaattgaagcaatggaaagccgagtacttcaatggcaccaacgttttggaacgtggtgtcggctatgttctgagcgacgaggcgaccggtaagtatttcacggtgaccaaagaaggcaatttcattccgctgcaactgacgggtaaagagaaagttatcacgggtttctccagcgatggtaagggtatcacctatttcggtacgagcggtacgcaggcgaagtctgcgtttgttaccttcaatggtaacacctactatttcgacgcgcgtggccacatggttaccaatagcgaatacagcccgaatggcaaggacgtctaccgttttctgccgaacggtatcatgctgagcaatgcgttttacattgatgcgaacggtaatacctacctgtacaactctaagggtcaaatgtacaaaggcggttacacgaaattcgatgtttctgaaacggataaggacggtaaagagtccaaggtcgtcaagttccgctactttacgaacgaaggcgtcatggccaagggtgttaccgtcattgatggttttacccaatacttcggtgaggacggctttcaagcgaaggataagctggtcaccttcaagggcaagacgtattacttcgacgcacacactggtaatggtatcaaagatacctggcgcaatatcaatggtaaatggtactatttcgacgcgaatggcgttgctgcgaccggtgcgcaggtgattaacggccagaaactgtacttcaacgaggatggctcccaagtcaaaggcggcgtggttaagaacgcagacggcacctatagcaaatacaaagaaggttttggtgagctggttactaacgagtttttcacgactgatggcaatgtttggtactacgccggtgcaaatggtaaaaccgttaccggtgcacaagtgatcaacggccaacatttgtacttcaatgcggacggttcccaggtgaagggtggcgttgtcaagaacgcggatggcacctacagcaagtacaatgctagcactggtgaacgtctgacgaacgagttctttacgaccggtgataacaattggtattacattggcgcaaacggtaagagcgtgacgggtgaggtcaagattggtgatgatacttactttttcgcgaaggatggcaaacaagttaaaggtcaaaccgtcagcgccggtaatggtcgcattagctactactacggtgacagcggcaagcgtgcggttagcacctggattgagattcagccgggtgtttatgtgtatttcgacaaaaacggtttggcgtaccctccgcgtgttctgaattaa

SEQ ID NO: 8 - protein, 1477 aa, Streptococcus salivarius
MDETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 9 - DNA, 4311 bp, Streptococcus downei
atggttgacggcaaatactactactacgatcaggacggcaacgtaaagaaaaacttcgcggttagcgtgggcgagaaaatctattactttgacgaaactggcgcctacaaagacaccagcaaagttgaggcggacaaaagcggcagcgacattagcaaggaagagactaccttcgcggcaaacaaccgcgcctacagcaccagcgcggagaattttgaggcgatcgacaattatctgaccgcggactcctggtatcgtcctaaatccatcctgaaggatggcaaaacgtggacggaaagcagcaaagatgactttcgtccgctgctgatggcgtggtggccggataccgaaacgaagcgcaattacgtgaactacatgaacaaagttgttggcatcgacaagacctataccgcggaaaccagccaggccgacttgaccgctgcggcggaactggtgcaagcacgcattgagcagaagatcacgaccgaacagaacacgaaatggctgcgtgaggcaatctcggcatttgttaaaacgcaaccgcagtggaacggtgaaagcgagaagccgtacgacgatcacctgcaaaacggtgctctgaaatttgataatcagagcgacctgaccccggatacgcaaagcaactaccgtctgttgaaccgtaccccgactaatcagacgggtagcctggacagccgcttcacttataacgcgaacgaccctttgggcggttatgagctgctgctggcaaatgacgtcgataacagcaatccgatcgtgcaggcggagcagctgaactggctgcattacctgctgaattttggtacgatctacgccaaagatgccgacgctaacttcgatagcattcgtgtggacgcggttgataacgtcgatgcggatctgctgcaaattagcagcgattacctgaaagcagcctacggcattgataagaataacaaaaacgcgaacaaccacgtgagcattgtcgaagcctggagcgataatgataccccgtacctgcatgacgatggtgacaacctgatgaatatggataacaaatttcgcctgtccatgctgtggtcgctggccaaaccgctggacaagcgtagcggtctgaacccgctgattcataacagcttggtggatcgtgaagttgatgaccgcgaggttgaaacggttccgagctattcttttgcacgtgcgcatgatagcgaggtccaggacttgatccgtgacatcatcaaggcagagatcaatccgaacgcattcggttatagctttacccaagacgagattgaccaggcctttaagatttacaatgaggatctgaagaaaacggataagaaatacacccactataatgtgccgttgagctacaccctgctgctgacgaataagggtagcatcccacgtgtctactatggtgatatgtttaccgacgatggtcagtatatggcgaacaaaaccgtcaactatgacgccattgaatctctgctgaaagcgcgtatgaagtatgtcgctggcggtcaagcaatgcagaactaccaaatcggtaatggtgagatcctgaccagcgttcgttatggtaagggtgccctgaaacagagcgacaaaggtgatgcgaccacgcgcaccagcggtgtcggtgtcgttatgggcaatcagccaaactttagcttggacggcaaagtggtggctctgaacatgggcgcagctcatgcgaatcaggagtatcgtgcgctgatggttagcacgaaagacggtgttgccacgtatgcgaccgatgcagatgcgagcaaagccggtctggtcaaacgtaccgacgaaaacggctacctgtatttcctgaatgacgacctgaagggtgtggccaatcctcaggtgagcggtttcttgcaggtgtgggttccggtgggtgccgcggatgatcaagatatccgtgttgcagctagcgataccgcatccaccgatggcaagagcctgcaccaagacgccgcgatggatagccgtgttatgtttgaaggcttctctaactttcagtcctttgccacgaaagaagaggaatataccaacgtcgttatcgccaacaatgtggataagttcgttagctggggtatcacggatttcgagatggccccacaatatgtttccagcaccgacggtcaattcctggactctgtcattcagaacggttatgcttttacggaccgttatgacttgggcatgtctaaggcaaacaaatacggcacggccgatcaactggttaaggccattaaggccctgcacgcgaagggcctgaaggttatggcagattgggtgccggatcagatgtataccttcccgaaacaggaagtcgtgaccgttacccgtaccgacaaatttggcaaaccgatcgcaggttcccaaatcaatcatagcctgtatgttaccgataccaagtccagcggcgatgactatcaggccaaatatggtggtgcgtttctggacgagctgaaggagaaatatccggagctgttcacgaagaaacaaatcagcacgggtcaagctattgacccgagcgtgaaaatcaaacagtggtctgctaagtatttcaatggctccaacatcctgggtcgcggtgcggactacgtactgtcggatcaggcgagcaacaaatacctgaacgtgtctgacgataaactgttcctgccgaaaaccttgctgggccaagttgtcgagagcggtatccgctttgacggcactggttatgtgtacaactctagcactacgggtgaaaaagttaccgattccttcattacggaggcaggtaatctgtactacttcggtcaagacggctatatggtgaccggcgcacagaacattaagggcagcaactattacttcctggccaatggtgcggccctgcgtaacaccgtttacaccgatgcgcaaggtcagaatcactattacggcaacgacggcaagcgttatgagaatggttaccaacagttcggcaacgattcttggcgttacttcaaaaatggcgtgatggcgctgggtctgactacggtggatggtcacgtgcagtatttcgataaagatggtgtccaggccaaggataagatcattgtcacccgcgatggcaaagtccgctatttcgaccagcacaacggtaatgcggttactaacacgttcgttgcggacaagacgggtcactggtactatctgggcaaagacggcgtcgcggttaccggtgcgcagactgtgggtaaacagcatttgtactttgaagcgaacggtcaacaagtcaagggtgacttcgtgacggctaaagacggtaaactgtacttctatgatgtggacagcggcgacatgtggaccaatacctttatcgaggataaagcgggtaattggttctacctgggtaaggacggtgcggccgtcaccggtgcacagacgatcaaaggccagaaattgtatttcaaagccaacggtcagcaagttaaaggtgacattgtcaaggacgcggacggtaagatccgttattacgacgctcagaccggtgaacaggtctttaacaagtccgttagcgtcaacggtaagacctactatttcggtagcgacggcaccgcgcaaacccaggcgaatccgaaaggccaaacctttaaggatggtagcggcgttctgcgtttctacaatttggagggccagtatgtctcgggcagcggctggtacgaaacggccgagcacgagtgggtatatgtgaaatccggtaaagttctgaccggtgcccagacgattggtaatcaacgtgtttacttcaaggacaatggtcaccaggtgaaaggccagctggtcacgggtaatgacggtaaattgcgttactacgacgcgaacagcggtgatcaagcattcaacaaatccgtcacggttaacggtaaaacctactactttggcagcgatggtacggcgcagacgcaggctaatcctaagggtcagaccttcaaagatggtagcggcgtgctgcgtttttacaacttggaaggccaatacgtgtctggcagcggttggtacaagaatgcgcagggccagtggctgtacgtgaaagatggcaaggtcctgaccggtctgcaaacggtcggcaatcagaaggtctacttcgacaaaaatggcatccaagcaaagggtaaggccgttcgcacgtccgatggtaaagtgcgctactttgatgagaatagcggtagcatgattacgaaccaatggaagttcgtttacggtcaatactattacttcggttctgacggcgcagcggtttaccgtggttggaactaa

SEQ ID NO: 10 - protein, 1436 aa, Streptococcus downei
MVDGKYYYYDQDGNVKKNFAVSVGEKIYYFDETGAYKDTSKVEADKSGSDISKEETTFAANNRAYSTSAENFEAIDNYLTADSWYRPKSILKDGKTWTESSKDDFRPLLMAWWPDTETKRNYVNYMNKVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYELLLANDVDNSNPIVQAEQLNWLHYLLNFGTIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDLIRDIIKAEINPNAFGYSFTQDEIDQAFKIYNEDLKKTDKKYTHYNVPLSYTLLLTNKGSIPRVYYGDMFTDDGQYMANKTVNYDAIESLLKARMKYVAGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQASNKYLNVSDDKLFLPKTLLGQVVESGIRFDGTGYVYNSSTTGEKVTDSFITEAGNLYYFGQDGYMVTGAQNIKGSNYYFLANGAALRNTVYTDAQGQNHYYGNDGKRYENGYQQFGNDSWRYFKNGVMALGLTTVDGHVQYFDKDGVQAKDKIIVTRDGKVRYFDQHNGNAVTNTFVADKTGHWYYLGKDGVAVTGAQTVGKQHLYFEANGQQVKGDFVTAKDGKLYFYDVDSGDMWTNTFIEDKAGNWFYLGKDGAAVTGAQTIKGQKLYFKANGQQVKGDIVKDADGKIRYYDAQTGEQVFNKSVSVNGKTYYFGSDGTAQTQANPKGQTFKDGSGVLRFYNLEGQYVSGSGWYETAEHEWVYVKSGKVLTGAQTIGNQRVYFKDNGHQVKGQLVTGNDGKLRYYDANSGDQAFNKSVTVNGKTYYFGSDGTAQTQANPKGQTFKDGSGVLRFYNLEGQYVSGSGWYKNAQGQWLYVKDGKVLTGLQTVGNQKVYFDKNGIQAKGKAVRTSDGKVRYFDENSGSMITNQWKFVYGQYYYFGSDGAAVYRGWN

SEQ ID NO: 11 - DNA, 3942 bp, Streptococcus mutans
atgattgacggcaaatactactactatgacaacaacggcaaagtacgcaccaatttcacgttgatcgcggacggtaaaatcctgcattttgatgaaactggcgcgtacaccgacactagcattgataccgtgaacaaggatattgtcacgacgcgtagcaacctgtataagaaatacaatcaagtgtatgatcgcagcgcgcagagcttcgagcatgttgatcactacctgacggcggaatcttggtaccgtccgaaatacattctgaaagatggcaagacctggacccagagcaccgagaaggacttccgtcctctgctgatgacctggtggccgagccaggaaacgcagcgccagtatgtcaacttcatgaacgcccagttgggtatcaacaaaacgtacgacgacaccagcaatcagctgcaattgaacatcgctgctgcaacgatccaagcaaagatcgaagccaaaatcacgacgctgaagaacaccgattggctgcgtcaaacgatcagcgcgttcgtcaaaacccaaagcgcttggaatagcgacagcgaaaagccgtttgatgaccatctgcaaaacggtgcggttctgtatgataacgaaggtaaattgacgccgtatgccaatagcaactatcgtattctgaaccgcacgccgaccaaccagaccggtaagaaggacccgcgttataccgccgacaacacgatcggcggctacgagtttctgctggccaacgacgtggataatagcaacccggtggttcaggccgagcagctgaactggctgcacttcctgatgaactttggtaatatctacgcaaacgaccctgacgctaacttcgactccatccgcgttgacgctgtcgataatgtggacgccgatctgttacagatcgcgggtgactatctgaaagcggcaaagggcatccataagaatgacaaagcggcgaacgaccacctgtccattctggaagcgtggagcgacaatgacactccgtatctgcatgatgatggcgacaacatgattaacatggataacaaactgcgcctgagcctgctgttctccctggcgaaaccgctgaatcagcgtagcggtatgaacccgttgattacgaacagcctggtcaaccgtactgatgataatgccgaaacggcggcagtgccaagctactcttttatccgtgcccacgatagcgaggtccaggatttgattcgtgatatcattaaggctgagattaacccgaacgtcgtcggttacagcttcacgatggaagagattaagaaggcatttgagatctacaataaggacctgttggccacggagaagaagtatacccactataacaccgcattgagctacgcgttgctgctgacgaacaagagcagcgtgccgcgtgtctactatggtgatatgtttacggacgatggtcaatacatggcccacaagaccattaactacgaggcaatcgaaaccctgctgaaagcacgtatcaagtacgtgtccggtggtcaggctatgcgcaaccagcaagtgggtaattcggagatcatcaccagcgtgcgttacggtaaaggtgcgctgaaggcgatggatacgggtgaccgcactacccgtacctctggtgtggcggtcattgagggcaacaacccgagcttgcgcctgaaggcttctgatcgtgtggttgtgaatatgggtgcggcccacaaaaatcaagcctatcgcccgctgctgttgacgaccgataacggcattaaggcctatcacagcgaccaagaagcggcaggcctggtgcgttacaccaacgaccgtggcgaactgatctttaccgcagccgacattaagggctacgcaaatccgcaagttagcggctacctgggcgtctgggtccctgttggcgcagcagctgatcaggacgttcgtgttgcggcgagcaccgcgccaagcacggacggcaagagcgttcaccagaacgcggctctggacagccgtgtgatgttcgagggtttctcgaacttccaggcatttgctaccaagaaagaagagtataccaatgtggtcatcgctaagaatgtggataagttcgcggagtggggtgtcaccgatttcgagatggctccgcaatacgtttctagcaccgacggtagctttttggatagcgtgattcaaaacggttatgcttttaccgaccgttacgacctgggcatcagcaagccgaacaaatatggcaccgcggacgatctggttaaagcgattaaggcattgcacagcaaaggcatcaaagttatggcggattgggttccggaccagatgtatgccctgccggaaaaagaggttgtgacggcaacccgtgttgacaaatacggtacgccggtagctggcagccagatcaaaaacacgctgtacgtggtcgatggtaaatctagcggtaaggaccagcaggcgaagtacggtggtgccttcctggaagagctgcaagcgaagtatccggaactgttcgcgcgcaaacagattagcaccggtgttccgatggacccgagcgtcaagattaagcaatggagcgcaaaatacttcaacggcacgaatatcctgggtcgtggtgctggttacgtgctgaaagatcaggcaaccaacacctactttaacatcagcgacaataaagagatcaatttcctgccaaagacgttgctgaaccaggattctcaagttggctttagctacgacggtaagggctatgtgtactacagcacctcgggctaccaggctaaaaacacgttcatcagcgagggtgacaagtggtattacttcgacaataacggttatatggttaccggcgcacagagcattaatggtgtgaactattacttcctgccgaatggtttacagctgcgtgatgcgattctgaaaaatgaggacggtacgtacgcgtattatggcaatgatggtcgccgctacgagaatggctattatcagtttatgagcggtgtttggcgccatttcaataatggcgagatgtccgttggtctgaccgtcattgacggtcaagttcaatactttgacgagatgggttaccaggcgaaaggcaaattcgttaccaccgcggatggtaagatccgttacttcgataagcagagcggcaatatgtatcgtaatcgtttcattgagaacgaagagggcaaatggctgtacctgggtgaggacggcgcggcagtcaccggtagccagacgatcaatggtcagcacctgtattttcgtgctaacggcgttcaggttaagggtgagttcgtgaccgatcgtcatggccgcatctcttattacgacggcaacagcggtgatcagatccgcaaccgtttcgtccgcaatgcgcaaggccagtggttttactttgacaacaatggctatgcagtaactggtgctcgtacgatcaacggccagcacctgtatttccgcgcgaacggtgttcaggtaaaaggtgagtttgttacggaccgccacggccgcattagctattatgatggtaatagcggtgaccaaattcgcaatcgtttcgtgcgtaatgcacagggtcagtggttctacttcgacaataatggttatgcagtcacgggtgcacgtaccattaacggccaacacctgtactttcgcgccaatggtgtgcaagtgaaaggcgaatttgttactgatcgttatggtcgtatcagctactatgatggcaattctggcgaccaaattcgcaatcgctttgttcgtaacgcccaaggtcaatggttctatttcgacaacaacggttacgcggtgaccggtgcccgcacgattaatggtcaacacttgtacttccgtgccaacggtgtccaggtgaagggtgaatttgtgaccgaccgctatggtcgcatttcttactacgacgcaaattccggtgaacgcgtccgtatcaattaa

SEQ ID NO: 12 - protein, 1313 aa, Streptococcus mutans
MIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNFMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKAMDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLPNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRHGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRYGRISYYDANSGERVRIN

SEQ ID NO: 13 - DNA, 3972 bp, Streptococcus dentirousetti
atggttgacggcaaatactactactacgatgcagacggcaacgtaaagaaaaacttcgcggttagcgttggcgatgccattttctattttgatgaaacgggtgcctacaaagataccagcaaagttgatgcggataagaccagctctagcgtcaatcagaccacggaaacgttcgcagcgaataaccgtgcgtatagcaccgcagccgagaactttgaagcgattgataactacctgactgcggatagctggtatcgtccgaagtctatcttgaaagatggtacgacgtggaccgaaagcaccaaggatgattttcgcccgctgctgatggcgtggtggccggataccgaaaccaaacgtaactacgtgaactatatgaacaaggtggtcggtatcgacaaaacgtacaccgcggaaacgtcccaagctgacctgacggcggcagccgaactggtgcaggcgcgtatcgagcagaaaatcactagcgaaaagaatacgaagtggctgcgtgaggcgatttccgcgttcgttaagactcaaccgcagtggaatggcgagagcgagaaaccttatgatgaccacctgcaaaatggtgcgctgaagttcgacaatgaaaccagcctgaccccggatacgcagagcggctatcgcatcctgaaccgtaccccgacgaatcaaaccggtagcctggacccgcgcttcacctttaatcagaatgacccgctgggtggttatgagtatttgctggctaatgatgtcgataacagcaacccggtcgttcaggccgagagcctgaactggctgcattacctgctgaattttggtagcatttacgcgaatgatccggaggccaatttcgacagcatccgtgtggacgcggtggacaatgttgacgcagacctgctgcaaattagctcggattacctgaaatcggcgtacaaaattgacaagaacaacaaaaatgcgaacgaccacgttagcatcgtcgaggcgtggagcgacaatgataccccgtacctgaatgatgatggcgacaatctgatgaacatggataacaagtttcgtctgagcatgctgtggagcctggcgaagccaaccaatgtccgtagcggcttgaatccgctgatccacaacagcgtggttgaccgtgaggtggacgaccgtgaagttgaggctaccccgaattacagctttgcacgcgcacacgacagcgaagttcaagatttgattcgcgacatcatcaaagctgagatcaacccaaacagcttcggttatagctttacccaagaggaaatcgaccaggccttcaagatctacaatgaggatttgaagaaaaccaataagaagtatacccactacaacgtcccgctgagctacaccctgctgctgacgaacaagggcagcattccacgcatttactacggtgacatgtttacggatgacggtcagtatatggccaacaaaaccgttaactatgacgccattgagagcctgctgaaagcacgtatgaagtatgttagcggtggccaagcgatgcagaattacaacatcggcaacggcgagattctgaccagcgtccgttacggtaagggtgccctgaaacagagcgacaaaggcgataagactactcgtaccagcggtattggcgttgtgatgggtaaccagagcaatttcagcctggagggcaaggtggtggccctgaatatgggtgcaacgcataccaaacagaagtatcgtgcattgatggtgtctacggaaaccggcgtggcgatttacaatagcgatgaagaagcagaggcagcaggcctgatcaaaacgaccgatgagaatggttatttgtactttctgaatgacgatctgaagggcgtggctaacccgcaggtcagcggcttcctgcaagtgtgggttccggttggtgcaccggctgaccaggacattcgtgtggcggcgaccgatgcggcttctaccgacggtaagagcctgcatcaggacgcagctctggattctcgcgtcatgtttgaaggtttcagcaacttccagagcttcgcaaccaaggaagaggaatacaccaacgttgttattgcaaagaacgtggataagttcgtgagctggggtatcaccgacttcgagatggcaccgcagtacgttagctctaccgatggcacctttctggatagcgtgattcaaaatggctatgcctttacggaccgttacgacctgggtatgagcaaagcaaacaagtatggtactgctgaccaactggtggccgcgattaaagcgctgcatgcgaagggtctgcgtgtgatggcggattgggtcccagatcaaatgtacactttccctaagaaggaagtggttaccgttacccgtacggacaaatttggcaatccagtggcaggcagccaaatcaaccacaccttgtacgtcactgatactaagggtagcggtgacgactaccaggcgaagtacggtggcgcattcctggatgaactgaaagaaaagtacccggagctgtttaccaagaagcaaatcagcaccggtcaggcaatcgacccgagcgtgaaaatcaagcagtggagcgcgaagtacttcaacggtagcaatatcttgggtcgcggtgcgaactacgtgctgtccgaccaggcgtctaacaagtactttaacgtggccgaaggtaaagtctttctgccagcggcgatgctgggtaaggtcgtcgagagcggtatccgtttcgacggtaaaggttatatctataacagcagcaccactggcgaacaagtgaaggacagcttcattaccgaagcgggtaacttgtactattttggcaaagatggttatatggtcatgggtgcacagaatatccagggtgctaactactacttcttggcgaatggtgcggccctgcgcaatagcatcctgacggatcaggatggcaaaagccactattatgcaaatgacggcaagcgttatgagaacggctactatcaattcggtaacgactcctggcgctattttgaaaacggcgttatggccgttggtttgacgcgcgttgcgggccacgaccaatactttgataaggatggtatccaagcgaagaataagatcattgttacgcgtgacggtaaggtccgctacttcgacgaacacaacggcaatgctgccacgaatacgtttatcagcgatcaagccggccattggtactacctgggtaaagatggtgtcgccgtgacgggtgcgcagaccgttggcaagcaacacctgtacttcgaggctaacggccaacaagtaaaaggcgattttgttaccgccaaggacggtaagttgtattttctggacggtgactctggcgacatgtggaccgataccttcgtccaggataaggctggtcattggttctatctgggcaaagacggtgcggcggtaaccggtgcccagaccgtccgtggtcagaagctgtacttcaaagcgaatggccagcaggttaagggtgacattgtgaaaggcgcggatggtaaaatccgttactatgatgcaaattccggtgaccaggtttacaatcgcacggtgaaaggctccgacggcaagacctatatcattggtaatgacggcgtcgcaatcacgcaaaccatcgccaaaggccagaccatcaaggatggcagcgttctgcgcttctatagcatggagggtcagctggtgaccggcagcggctggtattccaacgcgaaaggtcaatggttgtatgtcaagaacggtcaagtcctgacgggtttgcagacggtgggcagccagcgtgtgtactttgacgcaaatggtattcaagcgaaaggtaaagcagtgcgtacctccgatggcaaactgcgttacttcgatgcgaacagcggcagcatgatcaccaatcagtggaaagaagttaatggtcagtactactatttcgacaacaacggtgttgcgatctatcgcggttggaactaa

SEQ ID NO: 14 - protein, 1323 aa, Streptococcus dentirousetti
MVDGKYYYYDADGNVKKNFAVSVGDAIFYFDETGAYKDTSKVDADKTSSSVNQTTETFAANNRAYSTAAENFEAIDNYLTADSWYRPKSILKDGTTWTESTKDDFRPLLMAWWPDTETKRNYVNYMNKVVGIDKTYTAETSQADLTAAAELVQARIEQKITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLNDDGDNLMNMDNKFRLSMLWSLAKPTNVRSGLNPLIHNSVVDREVDDREVEATPNYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYDAIESLLKARMKYVSGGQAMQNYNIGNGEILTSVRYGKGALKQSDKGDKTTRTSGIGVVMGNQSNFSLEGKVVALNMGATHTKQKYRALMVSTETGVAIYNSDEEAEAAGLIKTTDENGYLYFLNDDLKGVANPQVSGFLQVWVPVGAPADQDIRVAATDAASTDGKSLHQDAALDSRVMFEGFSNFQSFATKEEEYTNVVIAKNVDKFVSWGITDFEMAPQYVSSTDGTFLDSVIQNGYAFTDRYDLGMSKANKYGTADQLVAAIKALHAKGLRVMADWVPDQMYTFPKKEVVTVTRTDKFGNPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPAAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGLTRVAGHDQYFDKDGIQAKNKIIVTRDGKVRYFDEHNGNAATNTFISDQAGHWYYLGKDGVAVTGAQTVGKQHLYFEANGQQVKGDFVTAKDGKLYFLDGDSGDMWTDTFVQDKAGHWFYLGKDGAAVTGAQTVRGQKLYFKANGQQVKGDIVKGADGKIRYYDANSGDQVYNRTVKGSDGKTYIIGNDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 15 - DNA, 4047 bp, Streptococcus oralis
atgatcgacggcaaaaactactacgtacaggatgatggcacggtaaagaagaatttcgcggtagaactgaatggtcgtatcctgtattttgatgcagaaaccggcgctctggttgatagcaacgagtatcagttccaacagggtacgagcagcctgaacaatgaattttctcagaagaacgcattctatggtacgaccgataaggatattgagactgtggatggctacctgaccgcagatagctggtatcgcccgaaattcatcctgaaggatggcaagacgtggaccgcgagcacggaaacggatctgcgtccgctgttgatggcatggtggccggacaagcgtacccaaatcaactatctgaactacatgaaccagcagggtctgggtgcgggtgcgtttgagaacaaagtggagcaggccctgctgacgggtgcaagccaacaggtacaacgcaagatcgaagagaagattggtaaagagggtgataccaagtggctgcgcaccctgatgggtgcgttcgtgaaaacgcaaccaaactggaatatcaaaaccgagtctgaaacgaccggcacgaaaaaggaccatctgcaaggcggtgcactgctgtatacgaacaacgagaaatccccgcacgcggacagcaaatttcgtctgctgaatcgtaccccgaccagccaaaccggcacgccgaagtatttcatcgacaagtctaacggtggctacgaatttctgctggcgaacgattttgacaatagcaatcctgcggtacaagctgagcagctgaattggctgcactacatgatgaactttggcagcattgttgcgaatgatccgaccgcgaatttcgacggcgttcgtgtggatgctgttgataacgtcaatgcggacttgttgcaaattgcaagcgattactttaagagccgttacaaagtcggtgagagcgaagaagaagcgatcaagcacctgtccatcctggaagcatggagcgataacgacccggactacaacaaagataccaagggtgcacagttggcgattgataacaaactgcgcctgagcctgctgtactctttcatgcgtaatctgagcatccgtagcggtgttgaaccgacgattaccaatagcctgaatgaccgttccagcgaaaagaagaacggcgagcgtatggcaaattacatcttcgtgcgtgcccacgatagcgaggtccaaacggtgatcgccgacatcattcgcgaaaacatcaatccgaacaccgacggcctgacgtttacgatggacgagctgaagcaggcattcaagatttacaacgaggacatgcgcaaggcggacaaaaagtatacccagtttaacattcctaccgcacacgcgctgatgctgtctaataaggattctattacccgcgtgtactatggtgatctgtatactgacgatggtcagtacatggagaagaaaagcccgtatcacgatgcgattgacgctctgctgcgtgcacgtattaaatacgtcgcgggtggccaggatatgaaagtgacctatatgggcgtgccgcgtgaagcggataagtggagctataacggcattctgaccagcgtgcgctatggcacgggcgctaacgaagccacggatgagggcactgcggaaacgcgcacgcaaggtatggcagtgattgcgagcaataatccaaatctgaaactgaatgaatgggacaagttgcaagtcaacatgggtgcggcgcataagaatcaatattaccgtccggttctgctgaccactaaggacggtatcagccgttatctgaccgatgaagaagtgcctcagagcctgtggaaaaagacggacgcaaacggtattctgaccttcgacatgaatgatattgctggctacagcaacgtgcaagttagcggttacctggccgtctgggtcccggtcggtgcgaaggcggatcaagatgcgcgcacgaccgcatccaagaagaaaaatgcgtcgggtcaggtgtacgaaagcagcgcggctctggatagccagctgatttacgaaggtttcagcaactttcaagactttgccactcgcgatgatcagtacacgaacaaggtcattgcgaaaaacgtgaatctgttcaaagaatggggtgtgaccagcttcgagctgccgccgcagtacgtgagcagccaagatggcacctttctggacagcattatccaaaacggctatgcatttgaagaccgttacgatatggcgatgagcaagaataacaagtatggtagcctgaaagacctgttgaacgcgctgcgcgcactgcacagcgtcaacattcaagcaatcgccgattgggtgccggaccaaatttacaacttgccgggcaaagaggtggtgaccgcaactcgtgtcaacaactacggcacctaccgtgagggtgctgaaatcaaagaaaagctgtatgtcgccaatagcaagaccaacgaaaccgatttccaaggtaaatacggtggtgcgttcctggatgagctgaaggcgaagtacccggagattttcgagcgtgtccaaatcagcaacggccaaaagatgactaccgatgaaaagatcaccaaatggagcgcgaaatactttaatggcaccaatattctgggtcgtggcgcgtactatgtcctgaaagattgggccagcaatgattacctgacgaaccgtaacggcgagattgttttgccgaagcaactggttaacaagaatagctataccggctttgtcagcgacgcgaacggcacgaagttctattctacctctggctaccaggcgaagaacagcttcattcaagacgaaaacggtaattggtattactttgacaaacgtggttatctggttacgggcgcacacgagattgatggcaagcatgtctacttcctgaaaaacggtatccaactgcgtgacagcatccgtgaggatgagaacggtaatcaatactattacgaccagaccggcgcacaagtgctgaaccgttactacacgacggacggtcagaattggcgctatttcgatgcgaaaggtgttatggcacgcggcctggtaaagattggtgacggccaacagtttttcgatgaaaacggttaccaggtcaagggcaagattgttagcgcaaaagacggcaagctgcgctactttgataaagactctggcaatgctgtcattaatcgtttcgcgcagggtgacaatccgagcgactggtactatttcggtgtggaatttgctaaactgacgggtttgcaaaagatcggccagcagacgctgtattttgaccaagacggtaagcaagtcaaaggtaagatcgtaactctgtcggacaaaagcattcgttacttcgatgccaacagcggtgaaatggcggttggcaagttcgcggaaggtgcaaagaatgagtggtattatttcgataaaaccggcaaagcggttactggtttgcagaaaattggtaagcagaccctgtactttgaccaggacggtaaacaggttaaaggcaaggttgtcacgctggctgataaaagcatccgctacttcgacgcagactccggcgagatggcggtcggtaagtttgcagagggtgcgaagaacgagtggtactattttgatcagactggcaaggccgtgactggtttgcaaaagattgacaagcaaaccttgtacttcgaccaggacggtaaacaagtcaagggtaagattgtgacgttgagcgacaagtcgatccgttactttgatgctaatagcggtgagatggctactaacaaattcgtcgagggctcgcagaatgaatggtactacttcgatcaagcgggtaaggctgttacgggcttgcaacaggtcggtcagcaaactctgtacttcacccaggatggtaagcaagtgaagggtaaggtcgtggacgtgaacggtgtttctcgttatttcgacgcaaactccggtgacatggctcgttctaaatggattcaactggaagatggcagctggatgtatttcgaccgtgacggtcgtggccagaattttggccgtaactaa

SEQ ID NO: 16 - protein, 1348 aa, Streptococcus oralis
MIDGKNYYVQDDGTVKKNFAVELNGRILYFDAETGALVDSNEYQFQQGTSSLNNEFSQKNAFYGTTDKDIETVDGYLTADSWYRPKFILKDGKTWTASTETDLRPLLMAWWPDKRTQINYLNYMNQQGLGAGAFENKVEQALLTGASQQVQRKIEEKIGKEGDTKWLRTLMGAFVKTQPNWNIKTESETTGTKKDHLQGGALLYTNNEKSPHADSKFRLLNRTPTSQTGTPKYFIDKSNGGYEFLLANDFDNSNPAVQAEQLNWLHYMMNFGSIVANDPTANFDGVRVDAVDNVNADLLQIASDYFKSRYKVGESEEEAIKHLSILEAWSDNDPDYNKDTKGAQLAIDNKLRLSLLYSFMRNLSIRSGVEPTITNSLNDRSSEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARTTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLKDLLNALRALHSVNIQAIADWVPDQIYNLPGKEVVTATRVNNYGTYREGAEIKEKLYVANSKTNETDFQGKYGGAFLDELKAKYPEIFERVQISNGQKMTTDEKITKWSAKYFNGTNILGRGAYYVLKDWASNDYLTNRNGEIVLPKQLVNKNSYTGFVSDANGTKFYSTSGYQAKNSFIQDENGNWYYFDKRGYLVTGAHEIDGKHVYFLKNGIQLRDSIREDENGNQYYYDQTGAQVLNRYYTTDGQNWRYFDAKGVMARGLVKIGDGQQFFDENGYQVKGKIVSAKDGKLRYFDKDSGNAVINRFAQGDNPSDWYYFGVEFAKLTGLQKIGQQTLYFDQDGKQVKGKIVTLSDKSIRYFDANSGEMAVGKFAEGAKNEWYYFDKTGKAVTGLQKIGKQTLYFDQDGKQVKGKVVTLADKSIRYFDADSGEMAVGKFAEGAKNEWYYFDQTGKAVTGLQKIDKQTLYFDQDGKQVKGKIVTLSDKSIRYFDANSGEMATNKFVEGSQNEWYYFDQAGKAVTGLQQVGQQTLYFTQDGKQVKGKVVDVNGVSRYFDANSGDMARSKWIQLEDGSWMYFDRDGRGQNFGRN

SEQ ID NO: 17 - DNA, 4047 bp, Streptococcus sanguinis
atgattgatggtaaaaagtattacgtacaggacgacggcacggttaagaagaatttcgcggttgagctgaatggcaagatcctgtacttcgatgcagagactggtgcgttgattgacagcgcggagtatcaattccaacaaggcaccagcagcctgaataatgagttcactcaaaagaacgccttttacggtacgaccgataaggatgtggaaaccattgatggttacttgaccgccgattcctggtatcgtccgaagttcattctgaaagatggcaaaacctggacggcgagcacggaaattgacttgcgtccgttgttgatggcgtggtggccggacaaacagacccaggttagctacctgaattacatgaaccagcaaggcttgggtgcaggcgccttcgaaaacaaagtagagcaggcaattctgaccggtgcgtcccaacaggtacaacgtaaaatcgaagaacgcatcggtaaagagggtgataccaagtggctgcgtaccctgatgggtgcatttgtaaagacccagccgaactggaacattaagaccgagtccgaaaccactggcacgaataaagatcatctgcaaggtggcgcactgctgtatagcaattccgacaagacgagccatgccaactctaagtaccgtatcctgaaccgcaccccgaccaaccaaacgggcacgccgaaatactttattgacaagagcaatggtggttatgaatttctgctggcgaatgactttgacaatagcaatccggcagtgcaagcggaacagctgaactggttgcactttatgatgaattttggctccatcgttgcaaatgatccgacggccaacttcgacggcgtccgcgttgacgctgtggataacgtgaatgcggatctgttgcaaattgcgagcgactatttcaagagccgctataaagtcggcgaaagcgaagaagaggccattaagcacctgtccatcctggaagcgtggagcgacaacgacccggactacaacaaggatactaaaggtgcccaactgccgatcgacaacaaactgcgtctgagcctgctgtactccttcatgcgtaagctgagcatccgtagcggcgtcgagccgaccatcaccaactctctgaatgatcgcagcacggagaagaagaatggtgagcgtatggcaaactatatcttcgttcgtgcacatgatagcgaggtgcaaacggtcatcgccgacattatccgtgagaacatcaatccgaataccgacggcctgacgttcacgatggatgaactgaagcaggcctttaaaatttacaatgaggatatgcgtaaagccgacaaaaagtacacgcagttcaatatcccgaccgcgcacgcgctgatgctgagcaacaaagattctatcacccgcgtttactacggtgacctgtatacggatgacggtcagtatatggaaaagaaaagcccgtatcacgacgccattgacgctctgctgcgtgcgcgtatcaaatatgttgcgggtggtcaggacatgaaggtgacctatatgggcgtgccgcgtgaggcagataaatggagctataacggcatcctgaccagcgttcgttatggtacgggtgccaacgaggcaaccgacgagggtacggcagaaacccgtacccagggcatggccgtcattgccagcaacaatccgaacctgaaactgaacgagtgggacaagttgcaggtcaacatgggtgcagctcacaaaaaccaatactatcgtccggtgctgctgaccaccaaggacggcatctcgcgctacctgaccgacgaagaagtcccgcagagcctgtggaaaaagaccgatgcgaacggcatcttgacgtttgacatgaatgatattgcgggttacagcaacgtccaagtgagcggttatctggccgtctgggttcctgtgggtgcgaaggcggaccaggacgctcgtgttacggcatctaagaagaaaaatgcctctggccaagtttacgaaagcagcgcagccctggactcccagctgatctatgagggcttcagcaattttcaggactttgccacccgtgacgaccagtacactaacaaggttatcgcgaaaaacgtcaatctgtttaaagagtggggcgtcaccagcttcgaattgccgccacagtatgtgagcagccaagacggtacgttcctggatagcatcatccagaatggttatgcattcgaagatcgctatgatatggcgatgagcaaaaacaataagtacggtagcttgaacgacctgttgaacgccttgcgtgcactgcatagcgtgaatatccaagcgattgcggattgggtgccggaccagatttacaatctgccgggtaaagaagttgtcactgcaacccgtgttaacaattatggcacgtatcgtgagggtagcgagattaaagagaacctgtacgttgctaacaccaaaaccaatggtacggactaccaaggtaagtatggtggtgcgttcttggacgagctgaaagccaaataccctgagatttttgagcgcgtccaaatcagcaacggccagaagatgaccaccgacgagaagattacgaaatggtccgccaaacactttaacggcacgaacattctgggtcgtggtgcgtattatgtgctgaaagactgggcgagcaacgagtacctgaataacaaaaatggcgagatggttctgccgaagcagctggttaataaaaatgcatataccggcttcgtcagcgacgcgagcggcaccaaatactattctaccagcggctatcaggctcgtaatagctttattcaagatgaaaatggtaattggtactacttcaataaccgtggttatttggtgacgggtgcacaggaaatcgacggtaagcaactgtatttcctgaaaaacggcattcagctgcgtgattctctgcgtgaggacgaaaacggcaaccagtattactatgataagacgggtgcgcaagttctgaatcgttattacactacggacggccaaaattggcgctacttcgacgttaaaggcgtcatggcccgtggtctggtcacgatgggtggtaaccaacaattctttgaccaaaacggttaccaggttaaaggcaaaattgcgcgtgcaaaagacggtaaactgcgttacttcgataaagacagcggtaatgcggcagctaaccgtttcgcccaaggcgataaccctagcgactggtactatttcggtgcagatggtgttgcggttacgggcctgcaaaaggttggtcagcaaactctgtactttgatcaggacggcaagcaggtgaaaggtaaagttgttaccttggcggacaaaagcattcgttatttcgatgcaaacagcggcgagatggcggtgaacaagtttgtggaaggtgctaagaacgtgtggtactacttcgatcaagcaggcaaagcggtgaccggcctgcaaaccatcaataaacaagtgctgtatttcgaccaggatggtaaacaagtcaaaggtaaggtggtcacgctggctgataagtctatccgctacttcgacgcgaacagcggtgagatggcagtgggcaaattcgccgaaggcgcaaagaatgagtggtattactttgaccaggcgggcaaggctgttaccggtctgcaaaagatcggccaacagacgctgtatttcgaccagaacggtaaacaggttaagggtaaagtggtcaccctggcggataagagcatccgctatttcgacgctaactctggcgaaatggcaagcaataagttcgttgagggtgccaaaaatgaatggtactatttcgatcaggctggcaaggcagtgacgggtctgcaacaaattggccagcagaccctgtattttgaccagaatggcaaacaggtgaagggtaagattgtgtatgttaatggtgcgaatcgctactttgatgccaatagcggtgaaatggcgcgtaacaagtggattcagctggaagatggcagctggatgtattttgaccgcaatggtcgtggtcgtcgtttcggttggaactaa

SEQ ID NO: 18 - protein, 1348 aa, Streptococcus sanguinis
MIDGKKYYVQDDGTVKKNFAVELNGKILYFDAETGALIDSAEYQFQQGTSSLNNEFTQKNAFYGTTDKDVETIDGYLTADSWYRPKFILKDGKTWTASTEIDLRPLLMAWWPDKQTQVSYLNYMNQQGLGAGAFENKVEQAILTGASQQVQRKIEERIGKEGDTKWLRTLMGAFVKTQPNWNIKTESETTGTNKDHLQGGALLYSNSDKTSHANSKYRILNRTPTNQTGTPKYFIDKSNGGYEFLLANDFDNSNPAVQAEQLNWLHFMMNFGSIVANDPTANFDGVRVDAVDNVNADLLQIASDYFKSRYKVGESEEEAIKHLSILEAWSDNDPDYNKDTKGAQLPIDNKLRLSLLYSFMRKLSIRSGVEPTITNSLNDRSTEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARVTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLNDLLNALRALHSVNIQAIADWVPDQIYNLPGKEVVTATRVNNYGTYREGSEIKENLYVANTKTNGTDYQGKYGGAFLDELKAKYPEIFERVQISNGQKMTTDEKITKWSAKHFNGTNILGRGAYYVLKDWASNEYLNNKNGEMVLPKQLVNKNAYTGFVSDASGTKYYSTSGYQARNSFIQDENGNWYYFNNRGYLVTGAQEIDGKQLYFLKNGIQLRDSLREDENGNQYYYDKTGAQVLNRYYTTDGQNWRYFDVKGVMARGLVTMGGNQQFFDQNGYQVKGKIARAKDGKLRYFDKDSGNAAANRFAQGDNPSDWYYFGADGVAVTGLQKVGQQTLYFDQDGKQVKGKVVTLADKSIRYFDANSGEMAVNKFVEGAKNVWYYFDQAGKAVTGLQTINKQVLYFDQDGKQVKGKVVTLADKSIRYFDANSGEMAVGKFAEGAKNEWYYFDQAGKAVTGLQKIGQQTLYFDQNGKQVKGKVVTLADKSIRYFDANSGEMASNKFVEGAKNEWYYFDQAGKAVTGLQQIGQQTLYFDQNGKQVKGKIVYVNGANRYFDANSGEMARNKWIQLEDGSWMYFDRNGRGRRFGWN

SEQ ID NO: 19 - DNA, 4023 bp, unknown
  unknown Streptococcus sp. C150
atgatcgacggcaaatactactacgtaaacgaggacggcagccacaaagagaatttcgcgatcacggttaatggtcaactgctgtattttggtaaggatggcgcgctgaccagcagcagcacgtacagcttcacccaaggcactaccaatattgtggacggttttagcattaacaaccgtgcgtatgactccagcgaggcctctttcgagctgattgacggttatctgactgcggactcttggtaccgtccggcgagcattatcaaagacggtgtgacgtggcaagcatccaccgccgaggacttccgcccgttgctgatggcgtggtggccgaacgttgatactcaggtgaactacctgaactacatgtccaaagtctttaatctggatgctaaatacagctcgactgataaacaggaaaccctgaaggtggcggcgaaagatatccagatcaaaattgaacaaaagattcaggcggaaaagtccacgcaatggctgcgtgaaacgatcagcgcctttgtaaaaacccagccgcaatggaacaaagagactgagaactacagcaagggcggtggtgaggaccatctgcaaggtggtgccctgctgtatgttaatgactctcgtaccccgtgggcgaacagcaactatcgtttgctgaaccgcacggcgaccaaccagaccggtacgatcgacaagagcatcctggacgagcagagcgatccgaatcacatgggtggttttgatttcttgctggctaatgacgttgacttgagcaatccggtcgtccaggcggaacaactgaatcagatccactacctgatgaattggggttctattgtcatgggtgataaagacgcgaattttgacggtattcgtgtagacgcggtggataatgttgatgcggacatgctgcaattgtacaccaactatttccgcgaatactatggtgtcaacaaaagcgaggcaaacgcgctggcgcacattagcgtcctggaagcctggagcctgaatgacaaccattacaatgataagactgatgttgcggcgctggcaatggagaataagcagcgcttggcactgttgtttagcctggcgaaaccgattaaagaacgcacgcctgccgtgtctccgctgtacaacaatacgtttaacaccactcagcgtgatgaaaagacggactggatcaataaagatggttcgaaagcctacaatgaggatggcactgtcaagaaaagcaccatcggcaagtataacgagaagtatggtgatgctagcggcaactacgttttcatccgcgctcacgacaataacgtgcaagacatcatcgcggagatcattaagaaagagattaacgagaaatctgacggttttaccattacggattcggagatgaagcgtgcatttgagatctataacaaagacatgctgtctaatgacaaaaagtacacgctgaataacatcccggcggcgtacgcggttatgctgcaaaacatggaaacgattacccgcgtgtattacggcgatctgtacacggacgacggtaattacatggaagcgaaaagcccgtactacgatacgattgttaacttgatgaagtctcgcatcaaatacgtgagcggtggccaggcgcagcgcagctactggctgccgaccgatggtaagatggataagtcggatgttgagctgtaccgtacgaacgaagtgtacacgagcgtccgttacggcaaagacattatgaccgccgatgacacgcaaggtagcaaatacagccgtaccagcggtcaggtgaccctggtcgtcaacaacccaaaactgaccttggaccaaagcgcaaagctgaacgtggttatgggcaagattcatgctaatcagaagtaccgcgcactgattgtcggtaccccgaacggtattaagaatttcaccagcgacgcagaggctattgccgcaggctatgtcaaagaaaccgatggcaatggcgtgctgaccttcggtgcaaacgacatcaagggttatgaaactttcgatatgagcggcttcgtcgctgtttgggttccggtcggtgcgagcgacgaccaagatattcgtgtggcggcgtctacggcagcaaagaaagagggtgagctgacgctgaaagcgaccgaagcctatgactcccaactgatctatgaaggctttagcaatttccagaccatcccagatggcagcgatccttctgtttataccaatcgtaagatcgcggaaaatgttgatttgttcaagagctggggtgtcacgagcttcgaaatggctccgcagttcgtttctgcggacgatggcacgtttctggacagcgtcattcaaaacggctatgcgttcgcagaccgttatgatctggccatgagcaaaaacaataagtacggtagcaaagaagatctgcgtaacgcgctgaaggcactgcacaaagcaggcattcaggcgattgcagattgggtgccagaccaaatctaccagctgcctggcaaagaagttgttactgccacccgcacggacggtgctggtcgcaaaatcagcgatgcaatcatcgatcattccctgtacgttgcgaactccaagagctccggtaaggactaccaagcgaagtacggtggcgagttcttggcggaactgaaggcgaaatacccggaaatgttcaaagtgaacatgattagcaccggcaaaccgattgatgatagcgtgaaactgaagcagtggaaagcagaatacttcaacggcaccaatgtgctggatcgcggtgtcggttatgttctgagcgatgaggcaaccggtaagtatttcaccgttaccaaagagggtaactttatcccgttgcagctgaagggtaacaagaaggtgattaccggcttttccagcgacggtaagggcattacctatttcggtactagcggtaaccaagctaaatccgcgttcgtcacttttaacggtaacacgtactacttcgacgcacgtggccacatggttaccaacggtgagtactcgccgaatggtaaagatgtgtatcgttttctgccgaacggcattatgctgagcaacgcgttctatgttgacggcaatggcaacacctacctgtacaactccaaaggccaaatgtataaaggtggctatagcaaatttgacgtcacggaaacgaaggacggtaaagagagcaaagttgtcaagttccgctactttacgaacgagggcgtgatggcgaaaggtgtcacggttgtggatggcttcactcagtactttaacgaggatggcattcaaagcaaagacgagctggtcacttacaatggcaagacctattacttcgaagcacacacgggcaatgccattaagaatacgtggcgtaatatcaagggcaaatggtaccattttgatgctaacggtgtcgcggctactggcgcacaggttatcaacggtcagcacctgtacttcaatgaagatggctctcaagtaaaaggtagcatcgtcaaaaacgctgatggtacgttcagcaagtacaaggacagctctggcgatctggtggtgaacgagtttttcacgacgggtgataacgtctggtactatgctggtgccaatggcaaaacggttactggtgcacaggtgattaatggccagcacttgttcttcaaagaggatggcagccaggtcaagggcgactttgtgaagaatagcgacggcacctactccaagtatgacgctgcgagcggcgaacgtctgaccaacgagttcttcactacgggcgacaatcattggtactatattggcgccaacggtaagaccgttaccggtgaagttaagattggtgacgacacgtatttcttcgcaaaagacggtaagcaactgaaaggtcaaatcgttaccacccgtagcggtcgtatcagctactactttggtgatagcggtaagaaggctattagcacgtgggtggagatccagccgggtgtgtttgttttcttcgacaaaaacggcctggcttacccaccggagaatatgaactga

SEQ ID NO: 20 - protein, 1340 aa, unknown
  unknown Streptococcus sp. C150
MIDGKYYYVNEDGSHKENFAITVNGQLLYFGKDGALTSSSTYSFTQGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSNYRLLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDVAALAMENKQRLALLFSLAKPIKERTPAVSPLYNNTFNTTQRDEKTDWINKDGSKAYNEDGTVKKSTIGKYNEKYGDASGNYVFIRAHDNNVQDIIAEIIKKEINEKSDGFTITDSEMKRAFEIYNKDMLSNDKKYTLNNIPAAYAVMLQNMETITRVYYGDLYTDDGNYMEAKSPYYDTIVNLMKSRIKYVSGGQAQRSYWLPTDGKMDKSDVELYRTNEVYTSVRYGKDIMTADDTQGSKYSRTSGQVTLVVNNPKLTLDQSAKLNVVMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNKKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGSIVKNADGTFSKYKDSSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 21 - DNA, 4479 bp, Leuconostoc mesenteroides
atgaccccatccgtattaggtgattcttccgtcccagatgtatcggctaacaatgtgcaatccgcgagcgataatacgacggacacccagcaaaataccaccatcaccgaggaaaatgataaggtccagagcgctgcgaccaacgataacgtgaccacggcagcgtccgacacgacgcagagcgccgataacaacgttaccgagaaacaatctgatgatcacgcgctggataatgaaaaggttgacaataagcaggacgaggtcgcccagaccaacgtgactagcaaaaacgaggagagcgcggtggcctctaccgacaccgatccggcagagactaccacggacgaaacgcaacaggttagcggcaagtatgtggaaaaggatggttcttggtattactactttgacgacggtaagaacgcgaagggtctgagcacgattgacaacaatatccaatactttgatgaaagcggtaagcaggtcaaaggtcagtatgtgacgattgataaccagacctattactttgataaagatagcggtgatgaactgaccggcctgcaatctattgacggtaacattgttgccttcaatgacgagggccagcagatctttaatcaatactaccagagcgagaacggtacgacctactattttgatgataagggccacgctgccaccggtattaagaatattgagggcaagaactactattttgacaatctgggtcaactgaaaaagggcttctccggcgtgatcgacggtcagattatgacgtttgaccaggaaactggtcaagaggtttccaataccacgtccgagatcaaagagggcctgacgactcagaacactgattactctgaacataatgcggcgcacggtaccgacgccgaagattttgagaacatcgatggctatctgaccgccagctcctggtaccgtccgacggacattctgcgcaatggcactgactgggaaccgagcaccgacacggactttcgtccaatcttgagcgtttggtggccggataagaatacgcaggtcaactatctgaactacatggcggacctgggcttcattagcaacgcagacagcttcgaaacgggtgactctcagagcctgctgaacgaggcgtccaattacgtccagaaaagcatcgagatgaaaatctccgcgcaacagagcaccgagtggctgaaagacgccatggccgcgtttattgttacgcagccgcaatggaatgaaacttccgaagatatgagcaacgaccacttgcaaaacggtgcgctgacctacgttaacagcccgctgaccccggacgcaaacagcaactttcgcctgctgaatcgtacccctaccaaccagaccggcgaacaggcgtacaacctggataattctaaaggtggctttgagctgctgctggcaaatgatgtggataacagcaacccggtggttcaagcggaacaactgaattggctgtactacctgatgaatttcggtacgattaccgccaatgacgcggatgccaactttgacggcattcgcgtcgatgcagtggataacgtggatgctgatctgttgcagattgcggcagactactttaaactggcctacggtgtggaccagaatgatagcaccgcaaaccaacacctgtctatcctggaagattggagccacaacgacccgctgtatgtcacggatcaaggcagcgaccagctgactatggacgactacgtgcatacgcaattgatttggagcctgaccaaaagcagcgatatccgtggtaccatgcaacgttttgtggattactatatggtggaccgttccaatgactccacggagaatgaagcgatcccgaattacagctttgtccgcgcacacgatagcgaagttcaaaccgttatcgcgcaaatcgtgagcgatctgtatccagatgttgagaatagcctggctccgaccaccgagcagctggcagcagcattcaaggtgtataatgaagatgagaaattggccgacaaaaagtatacccaatacaacatggcgagcgcctatgcgatgctgctgaccaataaagacacggtgccgcgtgtctactatggcgacctgtataccgatgacggtcaatacatggcaacgaagagcccgtattacgacgcgattaacaccctgctgaaagctcgtgttcaatatgtcgcgggtggccaaagcatgagcgtggatagcaacgatgtgctgaccagcgttcgctatggcaaagacgcgatgacggcgagcgacacgggcaccagcgagactcgtaccgagggcgtcggtgtcattgtgtccaacaatgcggagctgcaactggaagatggtcatacggttaccctgcacatgggtgccgcgcacaaaaatcaggcataccgtgcgttgttgtccaccacggccgacggtctggcgtattatgatacggacgagaatgccccggtggcatatacggatgcgaacggtgacttgattttcaccaatgagtccatctacggcgttcagaatccgcaagtcagcggttacctggcggtgtgggtcccggttggtgcacaacaggaccaggacgcgcgcacggcaagcgataccaccactaacaccagcgataaagttttccacagcaacgcggctctggacagccaagtgatctacgagggcttcagcaacttccaagcgtttgcgactgattccagcgaatacaccaatgttgttattgctcagaacgctgatcaattcaaacaatggggcgtgacctcgtttcagctggctccgcagtaccgcagcagcacggacacttccttcctggatagcatcatccaaaatggttacgcgtttacggaccgctatgatctgggttatggcacgccgacgaagtacggtaccgcggaccaactgcgtgatgcaatcaaagcactgcatgcgagcggcatccaagcgattgcagattgggttccggaccagatttacaatctgccggagcaagaactggcgactgtcacgcgcacgaatagcttcggtgatgatgatactgacagcgacattgataatgctctgtatgtggttcaaagccgcggtggtggtcagtaccaagagatgtatggcggtgcgtttctggaggagttgcaagcgctgtaccctagcctgtttaaggtgaaccagatttctactggtgtcccgatcgatggtagcgtgaagattaccgagtgggctgcgaaatacttcaacggcagcaatatccagggtaagggtgcgggttacgtgttgaaagacatgggtagcaataagtacttcaaggtcgtgagcaataccgaggacggcgactatctgccgaaacagctgaccaacgacctgagcgaaaccggtttcacccacgacgacaagggtatcatctactacaccctgagcggctatcgtgcacagaacgccttcattcaagacgatgataacaattactattactttgacaagaccggtcacctggtcacgggtttgcagaaaatcaacaaccatacgtacttcttcctgccgaatggcattgagctggtgaaatccttcttgcagaacgaggatggcacgatcgtttacttcgataagaaaggtcatcaagtctttgatcaatacattacggatcaaaatggcaacgcgtactatttcgacgatgccggtgttatgctgaagtctggtctggcaacgattgatggtcatcagcagtacttcgatcagaatggcgttcaagttaaggacaagttcgttatcggtacggatggctacaagtactacttcgagccgggttgcggcaatttggcaattttgcgttacgtgcaaaatagcaagaaccaatggttctatttcgatggcaatggccacgcagtcacgggtttccaaaccatcaacggcaagaagcagtatttctacaacgatggtcaccaaagcaagggcgaatttatcaatgcggacggtgacaccttctacaccagcgccaccgacggtcgtttggtgacgggtgttcagaagatcaacggtatcacctacgcgtttgacaataccggcaacctgatcacgaaccagtattatcagctggcggacggtaagtacatgctgctggacgactctggtcgcgcaaaaacgggctttgtcctgcaagacggtgtcctgcgttatttcgaccagaacggtgaacaagtgaaggacgccattatcgtcgacccggacaccaacctgtcttattactttaacgcgacccagggtgtcgcggtgaaaaacgattacttcgagtaccaaggcaactggtacctgaccgatgcaaactaccagctgattaaaggcttcaaagcagttgacgactcgctgcaacacttcgacgaagttacgggtgtgcagaccaaggaaagcgctctgattagcgcacagggcaaagtttaccagttcgacaacaatggtaacgcggtgagcgcataa

SEQ ID NO: 22 - protein, 1492 aa, Leuconostoc mesenteroides
MTPSVLGDSSVPDVSANNVQSASDNTTDTQQNTTITEENDKVQSAATNDNVTTAASDTTQSADNNVTEKQSDDHALDNEKVDNKQDEVAQTNVTSKNEESAVASTDTDPAETTTDETQQVSGKYVEKDGSWYYYFDDGKNAKGLSTIDNNIQYFDESGKQVKGQYVTIDNQTYYFDKDSGDELTGLQSIDGNIVAFNDEGQQIFNQYYQSENGTTYYFDDKGHAATGIKNIEGKNYYFDNLGQLKKGFSGVIDGQIMTFDQETGQEVSNTTSEIKEGLTTQNTDYSEHNAAHGTDAEDFENIDGYLTASSWYRPTDILRNGTDWEPSTDTDFRPILSVWWPDKNTQVNYLNYMADLGFISNADSFETGDSQSLLNEASNYVQKSIEMKISAQQSTEWLKDAMAAFIVTQPQWNETSEDMSNDHLQNGALTYVNSPLTPDANSNFRLLNRTPTNQTGEQAYNLDNSKGGFELLLANDVDNSNPVVQAEQLNWLYYLMNFGTITANDADANFDGIRVDAVDNVDADLLQIAADYFKLAYGVDQNDSTANQHLSILEDWSHNDPLYVTDQGSDQLTMDDYVHTQLIWSLTKSSDIRGTMQRFVDYYMVDRSNDSTENEAIPNYSFVRAHDSEVQTVIAQIVSDLYPDVENSLAPTTEQLAAAFKVYNEDEKLADKKYTQYNMASAYAMLLTNKDTVPRVYYGDLYTDDGQYMATKSPYYDAINTLLKARVQYVAGGQSMSVDSNDVLTSVRYGKDAMTASDTGTSETRTEGVGVIVSNNAELQLEDGHTVTLHMGAAHKNQAYRALLSTTADGLAYYDTDENAPVAYTDANGDLIFTNESIYGVQNPQVSGYLAVWVPVGAQQDQDARTASDTTTNTSDKVFHSNAALDSQVIYEGFSNFQAFATDSSEYTNVVIAQNADQFKQWGVTSFQLAPQYRSSTDTSFLDSIIQNGYAFTDRYDLGYGTPTKYGTADQLRDAIKALHASGIQAIADWVPDQIYNLPEQELATVTRTNSFGDDDTDSDIDNALYVVQSRGGGQYQEMYGGAFLEELQALYPSLFKVNQISTGVPIDGSVKITEWAAKYFNGSNIQGKGAGYVLKDMGSNKYFKVVSNTEDGDYLPKQLTNDLSETGFTHDDKGIIYYTLSGYRAQNAFIQDDDNNYYYFDKTGHLVTGLQKINNHTYFFLPNGIELVKSFLQNEDGTIVYFDKKGHQVFDQYITDQNGNAYYFDDAGVMLKSGLATIDGHQQYFDQNGVQVKDKFVIGTDGYKYYFEPGCGNLAILRYVQNSKNQWFYFDGNGHAVTGFQTINGKKQYFYNDGHQSKGEFINADGDTFYTSATDGRLVTGVQKINGITYAFDNTGNLITNQYYQLADGKYMLLDDSGRAKTGFVLQDGVLRYFDQNGEQVKDAIIVDPDTNLSYYFNATQGVAVKNDYFEYQGNWYLTDANYQLIKGFKAVDDSLQHFDEVTGVQTKESALISAQGKVYQFDNNGNAVSA

SEQ ID NO: 23 - DNA, 3972 bp, Streptococcus criceti
atggttgatggcaaatactactactacgacgcagatggcaacgttaagaagaatttcgcgattagcgtcggtgacgcaatcttctactttgacgaaaccggtgcttacaaggacaccagcaaagttggtgcggataaaaccagcagcagcgcgaatcaaaccacggccaccttcgcggcaaacaaccgtgcctatagcactgcggcggagaactttgaggcaattgacaactatttgaccgcagacagctggtatcgtccgaagagcattctgaaagatggtaagacgtggaccgaatccaccaaagacgacttccgtccgctgctgatggcttggtggccggataccgaaactaaacgcaactatgtcaactatatgaataaggtcgtcggcattgataaaacctataccgcggagactagccaagccgacctgacggcagctgcggagctggttcaagcgcgcattgagcaacgcatcacgtctgagaagaacacgaaatggctgcgcgaggctattagcgcgtttgtcaagacccagccgcaatggaatggcgagtccgaaaagccgtatgatgatcatttgcagaacggtgcactgaagttcgacaacgaaacctctctgaccccggacacccagtctggttatcgtatcttgaatcgcacgccgaccaatcaaacgggcagcctggacccgcgtttcacctttaatcaaaatgatccgctgggtggctatgaatatctgctggcaaacgacgtggataatagcaacccggtggtgcaagcggagagcttgaattggctgcactacctgctgaacttcggcagcatctacgcgaatgatccggaagcgaatttcgattccattcgtgtagacgccgtggataacgtggatgcggatctgttgcagattagcagcgactacctgaaatctgcgtacaaaatcgataagaacaacaaaaatgcgaatgaccacgtgagcatcgttgaggcgtggagcgataacgacaccccgtacctgcacgatgaaggcgataacttgatgaatatggacaataagtttcgcctgagcatgttgcgctccctggcgaagcctctggacaaacgtagcggcctgaaccctctgatccataatagcgtcgttgatcgcgaggtggatgaccgtgaggttgagaaaattccgagctactcttttgcacgcgctcacgacagcgaggttcaggatctgattcgtgacatcattaaggcagaaatcaatccgaacagcttcggctacagctttacccaagaagaaatcgatcaagcgttcaagatctacaacgaggacctgaagaaaaccaacaagaagtacacccattacaatgtcccgctgtcttacaccttgctgctgacgaataagggtagcattccgcgtatttactacggcgacatgtttaccgacgatggccagtatatggcgaacaaaacggtgaattacaatgctattgagagcctgctgaaggctcgtatgaagtatgtgagcggtggtcaggcgatgcaaaactatcaaattggtaatggtgaaattctgacgtcggtgcgctacggtaaaggtgcgctgaagcaatcggacaagggcgacgcaacgacgcgtacctctggtattggtattgtcatgggcaaccagccgaatttctcgctggaaggtaaagtcgttgccctgaacatgggtgcagcgcatgccaatcaggagtatcgtgccctgatggtgagcactaaagacggcgtggcgacctatgcgacggatgcagacgcgagcaaagcgggtatgacgaaacgtaccgacgagaacggctacttgtatttcctgaatgacgacttgaagggtgttgcaaatccacagatctccggttttctgcaagtatgggtgccggtcggtgctcctgccgaccaggatattcgcgttgccgcgacgaacgctgcaagcacggatggtaagtccctgcaccaagatgcggcgatggatagccgtgttatgttcgagggtttttccaactttcaggcgttcgcaacgaaagaagatgagtatgctaatgttgttattgcgaaaaatgtggataagtttgttagctggggcatcactgactttgagatggcaccgcagtatacctctagcgatgacggtcagttcctggatagcgttattcagaatggttatgcattcacggaccgttatgatctgggtatgagcaaggcaaacaaatatggtacggcggaacacctggtcaaagctatcaaagcgttgcacaaagcaggtctgaaagttatggcggattgggtcccggaccagatgtatacctttccgaagaaagaggttgtcaccgttacgcgtacggacaagttcggtaaaccggttgcgggcagccaaatcaatcataccctgtatgtgactgacaccaaaggtagcggtgatgactatcaggccaaatacggtggtgcgtttctggacgagctgaaagagaaatacccggaattgtttacgaaaaagcagatttctacgggccaagcaatcgacccaagcgtcaagattaagcagtggagcgcgaaatactttaacggcagcaatatcttgggtcgtggtgcaaattacgtcctgagcgaccaggccagcaacaagtatttcaatgtggcggaaggtaaggtttttctgccaggcgccatgctgggcaaggtggtggaaagcggcatccgttttgacggcaagggctacatctataacagctcgaccaccggcgaacaagtcaaagatagcttcatcacggaagcaggtaatttgtattacttcggtaaagacggttacatggtcatgggtgcgcagaacattcaaggcgccaattactacttcctggccaacggtgcggcactgcgtaatagcatcctgaccgatcaagacggcaagtcccactactacgcgaacgacggcaaacgttatgaaaacggctattatcagtttggtaacgattcctggcgctacttcgagaatggtgtaatggccgtcggcgtgacccgtgtggctggccatgaccagtacttcgataaggatggtattcaagcgaagaacaagatcatcgttacccgcgatggtaaggttcgttacttcgatgagcacaatggcaatgcagtcaccaacacgttcattagcgatcaggcaggtcactggtactatctgggtaaggacggtgtggcggtgacgggtgcccaaacggtgggcaaacagcacctgtatttcgaggccaacggccagcaggtcaaaggcgattttgtgaccgcgaaagacggtaaactgtatttcttcgatggcgatagcggtgacatgtggaccgacacgttcgtccaagacaaaactggccattggttttacctgggtaaagatggtgcggcggtcaccggtgcacagaccgtgcgcggtcagaaattgtactttaaagccaacggtcagcaagttaagggcgacattgtcaaaggtgctgatggtaaaatccgttactatgatgcaaattcgggcgatcaggtctacaaccgtactgtgaagggttccgacggtaaaacctacatcatcggcaaagacggtgttgccattacgcagaccatcgcgaagggtcaaaccattaaggacggcagcgttctgcgtttctacagcatggaaggccagctggttaccggtagcggctggtattctaacgcgaaaggtcagtggctgtacgtgaagaatggtcaggttctgaccggtctgcaaaccgttggttcccaacgtgtgtacttcgacgctaacggtatccaagcgaagggcaaggccgtgcgcaccagcgacggtaagctgcgttactttgatgcgaacagcggtagcatgatcactaaccagtggaaagaggtgaacggtcaatactattactttgacaacaatggcgtcgccatctaccgcggctggaactaa

SEQ ID NO: 24 - protein, 1323 aa, Streptococcus criceti
MVDGKYYYYDADGNVKKNFAISVGDAIFYFDETGAYKDTSKVGADKTSSSANQTTATFAANNRAYSTAAENFEAIDNYLTADSWYRPKSILKDGKTWTESTKDDFRPLLMAWWPDTETKRNYVNYMNKVVGIDKTYTAETSQADLTAAAELVQARIEQRITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLHDEGDNLMNMDNKFRLSMLRSLAKPLDKRSGLNPLIHNSVVDREVDDREVEKIPSYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYNAIESLLKARMKYVSGGQAMQNYQIGNGEILTSVRYGKGALKQSDKGDATTRTSGIGIVMGNQPNFSLEGKVVALNMGAAHANQEYRALMVSTKDGVATYATDADASKAGMTKRTDENGYLYFLNDDLKGVANPQISGFLQVWVPVGAPADQDIRVAATNAASTDGKSLHQDAAMDSRVMFEGFSNFQAFATKEDEYANVVIAKNVDKFVSWGITDFEMAPQYTSSDDGQFLDSVIQNGYAFTDRYDLGMSKANKYGTAEHLVKAIKALHKAGLKVMADWVPDQMYTFPKKEVVTVTRTDKFGKPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPGAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGVTRVAGHDQYFDKDGIQAKNKIIVTRDGKVRYFDEHNGNAVTNTFISDQAGHWYYLGKDGVAVTGAQTVGKQHLYFEANGQQVKGDFVTAKDGKLYFFDGDSGDMWTDTFVQDKTGHWFYLGKDGAAVTGAQTVRGQKLYFKANGQQVKGDIVKGADGKIRYYDANSGDQVYNRTVKGSDGKTYIIGKDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 25 - DNA, 4308 bp, Streptococcus sobrinus
atggttgacggcaaatactactattatgatcaggatggcaacgttaagaagaatttcgcggttagcgttggtgacaagatctactactttgacgagactggtgcctacaaagacacctctaaagtggacgcggacaagtctagcagcgccgttagccaaaatgcgacgatctttgcggctaacaatcgtgcgtatagcacctctgctgagaactttgaggccgttgataactatctgacggcagatagctggtatcgtcctaaatctattctgaaagatggcaagacgtggaccgagtcgggtaaggacgacttccgtccgctgctgatggcgtggtggccggacacggagactaaacgcaattacgtgaattacatgaacctggttgtcggcatcgacaagacgtacaccgcggaaacctctcaagcagatttgaccgcagcggcggagctggtccaggcgcgtattgaacagaaaatcaccacggaacagaatacgaaatggctgcgcgaggcgatctctgctttcgtcaagacccagccgcagtggaatggtgaaagcgagaagccgtatgacgaccacctgcaaaacggtgctctgaaattcgataatcagagcgacctgaccccggacacccagagcaactatcgcctgctgaatcgcaccccgactaaccagactggcagcctggacagccgtttcacctataatgcgaacgatccgttgggtggctacgaatttctgctggctaacgacgtggataatagcaaccctgtggtgcaggcagaacaactgaactggttgcattacctgttgaattttggtagcatttacgcgaaagatgcggatgcaaacttcgattccatccgtgtggacgccgtggacaacgtcgatgcagatctgttgcagattagcagcgattacctgaaggcagcctatggcattgacaagaacaataagaacgcgaacaaccatgttagcattgttgaggcttggagcgataacgatacgccgtacctgcacgatgacggtgataacctgatgaacatggacaataagttccgcttgagcatgctgtggagcctggccaagccgctggacaagcgcagcggtctgaatcctctgattcataacagcctggtggaccgtgaggttgatgaccgtgaagtggaaacggttccgagctactcttttgcgcgtgcgcatgattccgaggtccaagacattatccgcgacattatcaaggccgaaatcaacccgaatagctttggttatagcttcacccaagaagagattgaccaggcgtttaagatctataatgaagatctgaagaaaaccgacaagaaatacacccactataatgtcccgttgagctatactttgctgctgacgaataaaggttcgattccgcgtgtgtattacggtgatatgttcaccgatgatggtcaatacatggcgaacaaaacggttaactatgatgccattgagtcgctgctgaaagcgcgcatgaagtacgttagcggcggtcaagcgatgcaaaactatcaaatcggcaatggtgagattctgaccagcgttcgttatggtaagggtgcattgaagcaatccgacaagggtgacgcgaccacgcgtacgtccggtgtgggcgtcgtgatgggcaaccagccgaactttagcctggacggcaaggtggtggcattgaacatgggtgccgctcatgcaaatcaggagtatcgtgcgctgatggtgagcaccaaggatggcgttgccacgtatgccaccgacgcggacgcaagcaaggcaggtctggtcaaacgcaccgatgaaaatggttatttgtactttctgaacgacgatctgaagggtgtggcaaacccacaagtcagcggtttcttgcaggtgtgggtcccagtgggtgcggctgacgatcaggacattcgtgttgcagcgagcgacacggctagcacggacggtaagtccctgcatcaagatgcggcaatggatagccgtgttatgtttgagggttttagcaacttccagagctttgcaaccaaagaagaagagtacaccaacgtagttattgcgaacaacgtggacaaattcgttagctggggtattaccgactttgagatggcaccgcaatatgtcagctccaccgatggccagtttctggatagcgttatccagaatggttacgcgttcaccgaccgttatgatctgggtatgagcaaagccaacaaatacggtaccgcggatcagctggttaaagcaatcaaagcgttgcacgcgaagggtctgaaggtgatggcggactgggttccagaccagatgtacacgtttccgaagcaggaagttgtcactgtcacgcgcaccgacaaatttggtaagccgattgcgggcagccaaatcaatcacagcctgtacgtgacggacaccaaatccagcggtgatgattaccaggccaaatatggtggtgcgttcctggatgagctgaaagagaaatacccggagctgttcaccaaaaagcagatctcgaccggtcaggcgatcgacccgagcgtgaagattaagcagtggagcgcgaaatactttaatggtagcaacattctgggtcgtggtgccgactacgtcctgtccgatcaagttagcaacaagtatttcaatgtggccagcgacacgctgtttctgccgtctagcctgttgggtaaggttgtcgaaagcggtattcgttacgatggcaaaggttatatctataacagcagcgcgactggcgaccaagtcaaggcgtcttttatcacggaagcaggcaatctgtactacttcggcaaagacggttacatggttactggtgcgcagaccattaacggtgcgaattacttcttcttggaaaatggtacggccctgcgtaataccatctacaccgatgcacagggcaactcccactattatgctaatgatggcaagcgttacgagaacggttaccagcagttcggcaacgattggcgttacttcaaagatggtaacatggccgtcggtctgaccacggtggatggtaacgttcagtatttcgacaaggacggtgtccaagctaaagacaagattattgtgacccgcgatggtaaggtgcgctactttgatcaacacaatggcaacgcggtcacgaatacctttatcgccgacaagaccggtcactggtactacctgggcaaagatggcgtcgcggtcaccggcgctcaaaccgtcggtaagcaaaaactgtattttgaggcgaacggtgagcaggtgaaaggcgactttgtgactagccatgaaggcaaactgtacttttatgatgttgacagcggcgacatgtggaccgataccttcatcgaggataaggccggcaactggttctacctgggtaaagacggcgcagcagttagcggtgcacagaccattcgcggtcaaaagctgtacttcaaggcgtacggtcaacaggtcaaaggtgacatcgttaaaggcaccgacggcaagatccgttactacgatgcgaaatccggcgagcaggttttcaataagacggtcaaagccgctgatggcaaaacctatgtgatcggcaacaatggtgtggcggtcgatccgagcgttgttaagggtcagacgttcaaagacgccagcggcgcactgcgtttttacaatctgaaaggtcaactggttacgggctccggttggtatgaaacggccaatcacgattgggtgtatattcagagcggtaaagcactgaccggtgagcaaaccatcaatggtcagcacctgtactttaaagaagatggccaccaagttaaaggtcagctggtcacccgtacggacggcaaagtgcgttactatgacgcaaattctggcgatcaagcgttcaacaagtccgtgacggttaacggcaaaacgtattacttcggtaatgatggtaccgcgcaaaccgcgggtaacccgaaaggccaaatcttcaaggacggcagcgttctgcgtttctatagcatggaaggccagctggtaattggcagcggctggtattccaacgcgcaaggccaatggctgtatgtgaagaatggtaaagtgttgaccggtttgcagaccgtcggttcccagcgcgtgtactttgatgagaatggcattcaagcaaaaggcaaagcggttcgcacgagcgacggcaaaattcgctacttcgacgagaacagcggtagcatgatcaccaatcaatggaagtttgtttacggtcaatactattactttggtaatgacggtgcggcaatctaccgtggttggaattaa

SEQ ID NO: 26 - protein, 1435 aa, Streptococcus sobrinus
MVDGKYYYYDQDGNVKKNFAVSVGDKIYYFDETGAYKDTSKVDADKSSSAVSQNATIFAANNRAYSTSAENFEAVDNYLTADSWYRPKSILKDGKTWTESGKDDFRPLLMAWWPDTETKRNYVNYMNLVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYEFLLANDVDNSNPVVQAEQLNWLHYLLNFGSIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIDQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAVTNTFIADKTGHWYYLGKDGVAVTGAQTVGKQKLYFEANGEQVKGDFVTSHEGKLYFYDVDSGDMWTDTFIEDKAGNWFYLGKDGAAVSGAQTIRGQKLYFKAYGQQVKGDIVKGTDGKIRYYDAKSGEQVFNKTVKAADGKTYVIGNNGVAVDPSVVKGQTFKDASGALRFYNLKGQLVTGSGWYETANHDWVYIQSGKALTGEQTINGQHLYFKEDGHQVKGQLVTRTDGKVRYYDANSGDQAFNKSVTVNGKTYYFGNDGTAQTAGNPKGQIFKDGSVLRFYSMEGQLVIGSGWYSNAQGQWLYVKNGKVLTGLQTVGSQRVYFDENGIQAKGKAVRTSDGKIRYFDENSGSMITNQWKFVYGQYYYFGNDGAAIYRGWN

SEQ ID NO: 27 - DNA, 4023 bp, Streptococcus salivarius PS4
atgattgacggcaaatactactacgtaaacaaagatggctcgcacaaagagaatttcgcaattaccgtgaatggtcagttgttgtatttcggtaaggacggtgcattgacgtctagcagcacctacagctttacgcagggcaccaccaacatcgttgatggctttagcaaaaacaaccgtgcgtacgattccagcgaggcgagctttgaactgatcgacggttatctgaccgcggactcctggtatcgtccggtgagcattatcaaggacggcgttacgtggcaagccagcaccaaagaggactttcgcccgctgctgatggcctggtggccgaatgttgacacccaggtcaactacctgaattacatgtcgaaggtgtttaacctggacgcgaagtatacgagcaccgacaaacaggttgacctgaatcgcgcagccaaggacattcaggttaagattgagcaaaagattcaggccgagaagagcactcaatggctgcgtgaagcgatttcggccttcgtcaaaacccagccgcagtggaataaagaaacggagaacttctccaagggtggtggtgaggatcatctgcaaggtggtgcactgctgtacgttaacgacccgcgtaccccgtgggctaactccaactaccgcctgctgaatcgtactgcgaccaaccagaccggcacgatcgacaagagcgttctggacgaacagagcgatcctaaccacatgggcggcttcgattttctgctggcgaatgacgtcgataccagcaatccggtggtgcaggcggaacaactgaatcagatccactacctgatgaattggggttccattgttatgggcgacaaagatgcaaacttcgatggtatccgcgtggacgcggtcgataacgttgacgcagatatgctgcaactgtacaccaactactttcgtgagtattatggcgtgaacaaaagcgaggcaaacgctttggcgcacatctcggtgctggaagcgtggagcttgaatgataatcactataatgacaagactgacggtgcggccctggcgatggagaacaaacagcgtttggccctgctgtttagcttggcgaaaccgatcaaagaacgtacccctgcggtgagcccgctgtacaacaacactttcaacacgacgcagcgtgacgaaaagaccgattggattaacaaagacggtagcaaagcctataatgaggacggcaccgtcaagcagtccaccatcggcaagtacaacgagaaatacggcgacgcgtccggcaattatgtgttcattcgcgcccacgataacaacgtccaagacattattgcagagatcattaagaaagaaatcaatccgaaaagcgacggtttcaccattaccgacgccgaaatgaaaaaggcattcgaaatctacaacaaagatatgctgtcctctgataagaaatacaccctgaacaacatcccagcggcctacgcggtgatgctgcaaaacatggaaaccattactcgtgtgtattacggcgatctgtataccgacgatggccattacatggaaaccaagagcccgtactacgacaccattgtgaacctgatgaagaaccgtatcaaatacgtgtccggtggtcaagcgcaacgttcctattggctgccgaccgacggtaagatggataaaagcgatgtcgaactgtatcgcaccaacgaggtgtacaccagcgtccgttacggtaaggacatcatgactgccgatgacacccaaggtagcaagtacagccgtaccagcggtcaggtgaccctggtggtgaacaacccgaagctgtctttggataagagcgcgaagctggacgtcgaaatgggcaagatccatgcaaaccagaaataccgtgctctgatcgtgggtacgccgaacggcatcaaaaacttcacgagcgacgccgaggcaatcgcggctggctacgtgaaagaaaccgacggcaatggtgtgctgaccttcggtgcaaatgacatcaaaggttacgaaacgtttgacatgagcggtttcgttgcagtttgggttccggtaggtgcaagcgatgatcaagacatccgtgtcgccgcaagcaccgcggcaaagaaagaaggtgagctgactttgaaggcaactgaggcgtatgactctcagctgatttacgaaggtttttcgaattttcagaccattccggatggtagcgatccgagcgtttacaccaatcgtaagatcgcggaaaatgttgatttgttcaagagctggggtgtgacctctttcgaaatggcgccacagtttgtgagcgcagacgacggtacgtttctggacagcgttatccagaacggctatgcgtttgcggaccgttatgatctggcgatgtccaaaaacaataagtacggttcgaaagaagatctgcgtaacgcgttgaaggctttgcacaaggccggcatccaagccattgcggactgggttccggatcagatctaccaactgccgggcaaagaagtagtgaccgccactcgtaccgatggtgccggtcgtaagattagcgatgcaattatcgatcacagcctgtacgtcgcaaacagcaagtcgtctggcaaagactatcaagctaaatacggtggtgagttcctggccgagctgaaagcaaagtacccggaaatgtttaaagtcaacatgattagcacgggtaaaccgatcgacgactctgtcaaactgaagcaatggaaggcggagtactttaacggtacgaatgttctggaccgtggtgttggttacgtcctgagcgatgaggcgacgggcaagtactttaccgttacgaaagagggtaactttatcccactgcaattgaaaggtaacgagaaagttatcacgggcttcagctctgacggcaagggcattacctatttcggcacctcgggtaatcaagcgaaaagcgcttttgtcacgttcaatggtaatacctactattttgacgcgcgtggccacatggttaccaacggcgaatatagccctaatggtaaggatgtgtatcgtttcctgccgaatggtattatgttgagcaatgcattctacgttgacggtaacggcaatacctacctgtacaactccaagggccaaatgtacaaaggtggttatagcaaattcgacgttacggaaaccaaagatggtaaagagagcaaagtggtgaaatttcgctactttaccaatgaaggtgtgatggcaaaaggtgttaccgtggtggacggcttcactcaatacttcaacgaagatggcattcagagcaaggacgaactggtgacctacaatggtaaaacctattacttcgaagcgcataccggtaatgcgatcaaaaacacgtggcgcaatatcaagggtaagtggtatcactttgatgcgaatggcgtggcggcaacgggtgcacaggttatcaatggtcagcacctgtactttaatgaggatggttcccaggtgaagggtggcgtcgtgaagaatgcggatggtaccttcagcaagtataaagatggttccggtgacctggtggtcaatgagttcttcactactggtgataacgtgtggtactacgctggtgccaacggcaaaactgtgacgggtgcccaggtcatcaatggccaacacctgtttttcaaagaggacggtagccaggttaagggtgatttcgttaagaacagcgacggcacctactctaagtatgatgcggccagcggcgaacgcctgacgaatgagtttttcacgaccggtgacaaccactggtactatattggtgccaatggcaaaaccgttaccggcgaagtcaagatcggtgatgatacgtacttcttcgcaaaagatggcaagcagctgaagggccagatcgtgacgacccgcagcggtcgtatcagctactacttcggcgactctggtaagaaggcgattagcacctgggtggagattcagccgggtgttttcgtgtttttcgacaaaaatggcctggcatatccgccggaaaacatgaattaa

SEQ ID NO: 28 - protein, 1340 aa, Streptococcus salivarius PS4
MIDGKYYYVNKDGSHKENFAITVNGQLLYFGKDGALTSSSTYSFTQGTTNIVDGFSKNNRAYDSSEASFELIDGYLTADSWYRPVSIIKDGVTWQASTKEDFRPLLMAWWPNVDTQVNYLNYMSKVFNLDAKYTSTDKQVDLNRAAKDIQVKIEQKIQAEKSTQWLREAISAFVKTQPQWNKETENFSKGGGEDHLQGGALLYVNDPRTPWANSNYRLLNRTATNQTGTIDKSVLDEQSDPNHMGGFDFLLANDVDTSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKKAFEIYNKDMLSSDKKYTLNNIPAAYAVMLQNMETITRVYYGDLYTDDGHYMETKSPYYDTIVNLMKNRIKYVSGGQAQRSYWLPTDGKMDKSDVELYRTNEVYTSVRYGKDIMTADDTQGSKYSRTSGQVTLVVNNPKLSLDKSAKLDVEMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNEKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGGVVKNADGTFSKYKDGSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 29 - DNA, 4026 bp, Streptococcus salivarius K12
atgacggacggtaaatactattatgtaaatgaggacggcagccacaaagagaatttcgcaattacggtaaacggtcaactgttgtactttggcaaggacggcgctctgacgagcagcagcacgcacagcttcacgccgggtactacgaatattgtggacggtttctcgatcaacaaccgtgcgtacgatagcagcgaagcgagctttgagctgatcaacggttacctgacggcggattcctggtatcgcccggtttctatcatcaaggatggcgtcacgtggcaggcaagcactgccgaggattttcgtccgctgttgatggcctggtggccgaacgttgatacccaggtgaactatctgaactatatgtccaaggtctttaacctggaagccaagtacaccagcaccgataaacaggctgatctgaaccgtgctgcaaaggatatccaggtcaagatcgaacagaagatccaggcggaaaagagcacgcagtggctgcgtgagactatctccgcgtttgttaaaacccagccgcaatggaacaaagagactgagaattactccaagggtggtggcgaagatcatctgcaaggcggtgcgctgttgtacgtgaacgacagccgtaccccgtgggcgaatagcaattaccgcctgctgaatcgcacggcaacgaaccagaccggtaccattaacaagtcggtgttggacgagcaatccgatccaaatcacatgggtggcttcgacttcctgctggcaaacgatgtggatctgagcaatcctgttgtgcaggccgagcagctgaatcaaatccattatctgatgaactggggcagcattgttatgggtgacaaagacgcgaattttgatggtatccgtgtggacgccgttgacaacgtgaacgctgacatgttgcagctgtacacgaactactttcgtgagtattacggcgtcaacaaaagcgaagcgcaagcgctggcgcacattagcgttctggaagcgtggagcttgaacgataaccactataacgacaaaaccgatggtgcggcactggcgatggagaataagcaacgtctggccttgctgttctctctggccaagccgatcaaagatcgtactccggcagtgagcccactgtataacaatactttcaataccacccaacgtgacttcaagacggattggattaacaaggacggtagcaccgcctacaatgaggatggcaccgcgaaacaatctaccatcggtaagtacaatgagaaatatggtgatgcaagcggtaactatgtgtttattcgtgcccatgacaataacgtccaagacattattgcggagatcattaagaaagaaatcaataagaagagcgatggttttaccatcagcgatagcgaaatgaaacaggcgttcgaaatctacaacaaagatatgctgagcagcaataagaaatacactctgaataacattccggcagcgtacgccgtgatgctgcaaaacatggagactatcacccgtgtgtattatggtgacctgtacaccgacgacggtcactatatggaaaccaagagcccgtatcatgacaccattgtgaacctgatgaaaaaccgtatcaagtacgtttctggtggccaggcccaacgctcctattggctgccgaccgacggtaaaatggacaatagcgatgtcgaactgtaccgtactagcgaggtctataccagcgttcgctacggtaaggacattatgacggcggatgacaccgagggtagcaagtactcccgcacgagcggtcaggttaccctggttgttaacaacccgaagctgactctgcatgaaagcgccaaactgaacgtcgagatgggtaagatccacgcaaaccagaaataccgtgcgctgattgtgggtaccgccgatggcatcaaaaactttacgtctgatgccgaagcgatcgcggcaggctacgtaaaagaaacggacagcaatggtgttctgaccttcggcgcaaatgatatcaaaggttacgagactttcgatatgagcggtttcgtcgcagtttgggtgccggtgggtgcgagcgatgatcaggacatccgcgtggcgccgtcgacggaagcgaagaaagaaggtgaactgacgctgaaagccacggaagcgtatgatagccagttgatttatgaaggcttctccaatttccagaccattccggatggcagcgacccgagcgtttataccaaccgcaaaattgctgagaatgttgatctgtttaagtcctggggtgtcactagcttcgaaatggctccgcagtttgtttcggcggacgacggcaccttcctggatagcgttatccagaacggttacgcctttgcggaccgttatgatttggccatgagcaagaacaacaagtacggttctaaagaggatctgcgcgacgcactgaaagcgctgcacaaagctggcattcaggcaatcgcggactgggtcccagaccaaatctaccaactgccaggcaaagaagtggttacggcgacgcgcacggacggtgcgggtcgcaagatcgcggacgccatcattgatcatagcctgtatgttgctaactccaagagctccggtcgcgattaccaagcgcagtatggtggcgagtttctggcagagctgaaagcgaagtacccgaaaatgttcacggaaaacatgattagcacgggtaagccgatcgatgacagcgtcaaactgaagcaatggaaagccaagtatttcaatggtacgaatgtgctggaccgtggtgtcggttacgtcctgtccgacgaggcgaccggcaaatacttcaccgttaccaaagagggtaacttcattccgctgcaactgaccggcaatgaaaaagcggtgaccggtttcagcaacgacggcaagggtatcacctactttggtacgagcggtaatcaggccaagagcgcgttcgtcacctttaacggcaatacgtactatttcgacgcgcgtggccacatggtcacgaacggcgagtatagcccgaacggcaaagatgtctaccgttttctgccaaatggtattatgttgtcgaacgcgttttatgtcgacgcaaacggtaatacgtacttgtacaactacaagggccagatgtacaaaggtggttatacgaaatttgatgtcaccgaaactgataaagatggtaatgagagcaaggtggtcaagtttcgttatttcaccaatgagggcgtcatggctaagggtctgaccgtcattgacggtagcacccagtactttggtgaggatggttttcaaacgaaggacaagctggcgacctataaaggtaagacttattacttcgaggcacacacgggcaatgcgatcaaaaacacctggcgtaacatcgacggtaagtggtatcacttcgatgagaatggcgttgccgcgaccggtgcacaagtgattaacggtcaaaaactgtatttcaacgaggatggctcgcaagtgaagggcggtgttgttaagaacgccgacggtacctacagcaaatacaaagagggcagcggtgagctggttaccaacgagtttttcacgaccgacggtaatgtgtggtactatgctggtgcggatggcaagactgtgaccggtgctcaggtcattaatggtcagcacctgtactttaaagaagatggcagccaggtgaaaggtggtgtggtgaaaaacgcggacggtacgtacagcaagtatgacgccgccaccggtgaacgcttgaccaatgagttctttaccacgggcgataacaattggtactatattggttctaatggtaagaccgtaaccggtgaagtcaaaatcggtgcggacacctattactttgccaaagatggcaaacaggtcaagggccaaaccgtcaccgcaggcaatggccgcatctcctattactacggcgattctggtaagaaagcaatcagcacgtggatcgaaattcaaccgggtatctatgtctattttgataagacgggcatcgcgtacccaccgcgtgtgctgaattaa

SEQ ID NO: 30 - protein, 1341 aa, Streptococcus salivarius K12
MTDGKYYYVNEDGSHKENFAITVNGQLLYFGKDGALTSSSTHSFTPGTTNIVDGFSINNRAYDSSEASFELINGYLTADSWYRPVSIIKDGVTWQASTAEDFRPLLMAWWPNVDTQVNYLNYMSKVFNLEAKYTSTDKQADLNRAAKDIQVKIEQKIQAEKSTQWLRETISAFVKTQPQWNKETENYSKGGGEDHLQGGALLYVNDSRTPWANSNYRLLNRTATNQTGTINKSVLDEQSDPNHMGGFDFLLANDVDLSNPVVQAEQLNQIHYLMNWGSIVMGDKDANFDGIRVDAVDNVNADMLQLYTNYFREYYGVNKSEAQALAHISVLEAWSLNDNHYNDKTDGAALAMENKQRLALLFSLAKPIKDRTPAVSPLYNNTFNTTQRDFKTDWINKDGSTAYNEDGTAKQSTIGKYNEKYGDASGNYVFIRAHDNNVQDIIAEIIKKEINKKSDGFTISDSEMKQAFEIYNKDMLSSNKKYTLNNIPAAYAVMLQNMETITRVYYGDLYTDDGHYMETKSPYHDTIVNLMKNRIKYVSGGQAQRSYWLPTDGKMDNSDVELYRTSEVYTSVRYGKDIMTADDTEGSKYSRTSGQVTLVVNNPKLTLHESAKLNVEMGKIHANQKYRALIVGTADGIKNFTSDAEAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGRDYQAQYGGEFLAELKAKYPKMFTENMISTGKPIDDSVKLKQWKAKYFNGTNVLDRGVGYVLSDEATGKYFTVTKEGNFIPLQLTGNEKAVTGFSNDGKGITYFGTSGNQAKSAFVTFNGNTYYFDARGHMVTNGEYSPNGKDVYRFLPNGIMLSNAFYVDANGNTYLYNYKGQMYKGGYTKFDVTETDKDGNESKVVKFRYFTNEGVMAKGLTVIDGSTQYFGEDGFQTKDKLATYKGKTYYFEAHTGNAIKNTWRNIDGKWYHFDENGVAATGAQVINGQKLYFNEDGSQVKGGVVKNADGTYSKYKEGSGELVTNEFFTTDGNVWYYAGADGKTVTGAQVINGQHLYFKEDGSQVKGGVVKNADGTYSKYDAATGERLTNEFFTTGDNNWYYIGSNGKTVTGEVKIGADTYYFAKDGKQVKGQTVTAGNGRISYYYGDSGKKAISTWIEIQPGIYVYFDKTGIAYPPRVLN

SEQ ID NO: 31 - DNA, 3918 bp, Streptococcus salivarius
atgatcgacggcaaacagtattatgtagagaacggtgtggttaagaaaaatgcggcaattgaactggatggccgcctgtactactttgatgagactggcgcaatggtcgatcagagcaaaccgttgtatcgtgcggacgcgattccgaacaactctatctacgccgtgtacaaccaagcgtatgataccagcagcaaatccttcgagcatttggataacttcctgaccgcggatagctggtatcgcccgaaacagattctgaaggacggtaaaaactggaccgcaagcactgagaaagactatcgtcctctgctgatgacctggtggccggacaaggtgacccaggtgaattacctgaactatatgtctcaacagggttttggtaacaaaacgtacaccacggatatgatgagctacgacctggcggctgcggcagaaacggtgcagcgtggcatcgaagagcgtatcggtcgcgagggtaacaccacgtggctgcgccagctgatgagcgatttcatcaaaacccagccgggttggaatagcgagagcgaggacaatctgctggttggtaaggaccatctgcaaggtggtgcgctgacctttctgaacaatagcgcaacgagccacgcgaatagcgactttcgtctgatgaaccgtaccccgaccaatcagaccggtacccgtaaataccacatcgatcgtagcaatggcggctatgagctgctgctggctaacgacattgataatagcaatccggcagttcaagcagagcaactgaattggctgcactacattatgaatattggcagcatcttgggtaatgacccgagcgcgaattttgacggtgttcgtatcgatgcggtggataatgtggacgcggatttgctgcaaatcgcgtctgattacttcaaagagaagtaccgtgtcgcggacaacgaggcaaacgcgattgcccacctgagcattctggaagcgtggagctataatgatcatcagtacaacaaggacacgaagggcgcacagctgtccatcgataacccgctgcgcgaaaccctgctgactaccttcctgcgtaaaagcaattatcgtggtagcttggagcgcgttattaccaactccctgaataaccgctctagcgagcaaaagcacactccgcgcgacgcgaactacatctttgtacgtgcgcatgacagcgaagttcaagacgtgctggcgaatatcattagcaaacagatcaacccaaagacggatggcttcacgttcaccatggatgaactgaagcaggcgttcgagatctacaatgcggatattgcgaaggcggacaagaagtatacccaatacaacattccggcagcttacgcaaccatgctgacgaacaaggatagcattacccgcgtttactacggcgacctgtttacggatgacggtcagtatatggccgagaaatccccgtactataacgcaattgacgctctgctgcgtgcgcgcattaagtacgtcgcgggtggtcaggacatgaaggtgactaaactgaatggttatgagattatgagcagcgtgcgttatggtaaaggtgcagaagaggctaaccagctgggtacggcagaaacccgcaatcaaggtatgctggttctgacggctaaccgtccggacatgaaactgggtgcaaacgatcgcctggtcgtgaatatgggcgctgcccacaaaaaccaggcctaccgcccgttgctgttgtccaaatctactggcctggcgacgtatctgaaagatagcgacgttccggcaggcctggtgcgttataccgataaccagggtaatctgacctttacggcggacgatattgcaggccatagcacggttgaagtgagcggttacttggcggtctgggttccggtcggcgcgagcgagaaccaggacgcgcgcacgaaggccagctctaccaagaagggcgagcaagttttcgaatctagcgccgctctggacagccaggttatctacgaaggtttctccaatttccaagattttgtcaagaccccgagccagtacaccaaccgcgtgatcgcgcaaaatgcgaagctgtttaaagaatggggcatcactagctttgagttcgcgcctcagtatgtttctagccaagacggcacctttttggatagcatcattgaaaacggctacgcgttcgaggatcgttacgatatcgcaatgagcaagaacaataagtatggcagcctgaaagatttgatggacgcactgcgtgcgttgcatgcggaaggcatcagcgcaatcgccgattgggtcccggaccaaatctataatctgccgggtaaagaagttgtcacggcgagccgtaccaacagctatggtaccccgcgtccgaatgcggaaatctacaatagcctgtacgctgctaaaacgcgcacgttcggtaatgacttccagggtaagtatggtggcgcatttctggacgaactgaaagcaaagtacccggccatctttgagcgtgttcaaatcagcaacggtcgtaaattgaccacgaatgagaagattacccagtggagcgccaaatactttaatggtagcaatattcagggcacgggtgcgcgttacgttttgcaggacaacgctaccaatcagtactttagcgttaaggcgggtcagactttcctgccgaagcagatgaccgaaattaccggcagcggtttccgtcgtgtcggtgacgatgtccaatatctgagcattggtggttatctggcgaagaatacctttatccaggtcggtgcgaatcagtggtattattttgacaaaaacggcaatatggttacgggtgaacaggtgatcgatggtaaaaagtacttcttcttggataacggtctgcaactgcgtcatgttctgcgccagggctccgatggtcacgtctattactatgaccctaaaggtgtgcaagcgttcaatggtttctacgactttgcaggccctcgccaagacgttcgttacttcgatggcaatggtcagatgtatcgcggcctgcacgatatgtacggtacgaccttttacttcgacgagaaaaccggcatccaagcaaaagacaagttcattcgcttcgcagacggtcgtacccgttacttcattccggacaccggtaatctggcagtgaatcgtttcgcccaaaacccggagaacaaagcctggtattacctggatagcaacggttacgctgtcaccggcttgcagacgattaatggcaagcagtattactttgacaacgaaggccgtcaggttaaaggccactttgtgaccattaacaaccagcgttactttctggatggtgactcgggcgagatcgcgccatcgcgtttcgttaccgagaacaacaagtggtactacgtcgacggtaatggtaagctggtcaagggtgcacaggtgattaacggtaaccactactacttcaataacgactatagccaggtgaagggtgcatgggcgaacggtcgttactacgatggcgacagcggtcaagcggtcagcaaccagtttattcaaattgcggcgaaccaatgggcatatctgaatcaagatggccacaaggtcacgggtctgcaaaacatcaacaataaagtgtactattttggctctaatggcgcgcaagttaagggtaaactgctgaccgtgcaaggcaagaaatgctactttgacgcccacaccggtgagcaagtcgttaatcgcttcgtggaagctgcccgtggttgctggtactatttcaattccgctggccaggccgttaccggccaacaagtcatcaacggtaagcagttgtattttgatggttctggtcgtcaagtcaaaggccgttatgtgtacgtgggtggtaaacgtttgttctgtgatgcgaaaacgggcgagctgcgtcaacgccgttaa

SEQ ID NO: 32 - protein, 1305 aa, Streptococcus salivarius
MIDGKQYYVENGVVKKNAAIELDGRLYYFDETGAMVDQSKPLYRADAIPNNSIYAVYNQAYDTSSKSFEHLDNFLTADSWYRPKQILKDGKNWTASTEKDYRPLLMTWWPDKVTQVNYLNYMSQQGFGNKTYTTDMMSYDLAAAAETVQRGIEERIGREGNTTWLRQLMSDFIKTQPGWNSESEDNLLVGKDHLQGGALTFLNNSATSHANSDFRLMNRTPTNQTGTRKYHIDRSNGGYELLLANDIDNSNPAVQAEQLNWLHYIMNIGSILGNDPSANFDGVRIDAVDNVDADLLQIASDYFKEKYRVADNEANAIAHLSILEAWSYNDHQYNKDTKGAQLSIDNPLRETLLTTFLRKSNYRGSLERVITNSLNNRSSEQKHTPRDANYIFVRAHDSEVQDVLANIISKQINPKTDGFTFTMDELKQAFEIYNADIAKADKKYTQYNIPAAYATMLTNKDSITRVYYGDLFTDDGQYMAEKSPYYNAIDALLRARIKYVAGGQDMKVTKLNGYEIMSSVRYGKGAEEANQLGTAETRNQGMLVLTANRPDMKLGANDRLVVNMGAAHKNQAYRPLLLSKSTGLATYLKDSDVPAGLVRYTDNQGNLTFTADDIAGHSTVEVSGYLAVWVPVGASENQDARTKASSTKKGEQVFESSAALDSQVIYEGFSNFQDFVKTPSQYTNRVIAQNAKLFKEWGITSFEFAPQYVSSQDGTFLDSIIENGYAFEDRYDIAMSKNNKYGSLKDLMDALRALHAEGISAIADWVPDQIYNLPGKEVVTASRTNSYGTPRPNAEIYNSLYAAKTRTFGNDFQGKYGGAFLDELKAKYPAIFERVQISNGRKLTTNEKITQWSAKYFNGSNIQGTGARYVLQDNATNQYFSVKAGQTFLPKQMTEITGSGFRRVGDDVQYLSIGGYLAKNTFIQVGANQWYYFDKNGNMVTGEQVIDGKKYFFLDNGLQLRHVLRQGSDGHVYYYDPKGVQAFNGFYDFAGPRQDVRYFDGNGQMYRGLHDMYGTTFYFDEKTGIQAKDKFIRFADGRTRYFIPDTGNLAVNRFAQNPENKAWYYLDSNGYAVTGLQTINGKQYYFDNEGRQVKGHFVTINNQRYFLDGDSGEIAPSRFVTENNKWYYVDGNGKLVKGAQVINGNHYYFNNDYSQVKGAWANGRYYDGDSGQAVSNQFIQIAANQWAYLNQDGHKVTGLQNINNKVYYFGSNGAQVKGKLLTVQGKKCYFDAHTGEQVVNRFVEAARGCWYYFNSAGQAVTGQQVINGKQLYFDGSGRQVKGRYVYVGGKRLFCDAKTGELRQRR

SEQ ID NO: 33 - DNA, 4026 bp, Streptococcus salivarius JIM8777
atgatcgacggcaaatactactatgtaaacgaggacggcagccacaaagagaatttcgcgattacggtaaacggtcagctgctgtactttggtaaggacggtgctctgacgagcagctccacgtacagctttaccccgggtacgaccaatattgtcgatggcttcagcattaacaaccgtgcgtatgacagcagcgaggcatcctttgagctgatcgatggttatttgaccgcggatagctggtatcgtccggcgagcatcattaaggacggcgttacgtggcaggcctcgaccgcagaagattttcgtccgctgctgatggcttggtggccgaatgttgacacccaggtgaattatctgaattacatgtccaaggttttcaacctggatgcaaagtacaccagcaccgacaagcaggaaaccctgaacgtggctgcgaaagatatccaagtcaagattgagcaaaagattcaggcagagaaatctacccagtggctgcgtgaaacgattagcgcgtttgttaaaactcagccgcaatggaataaagaaacggaaaactattccaagggtggtggcgaggaccatctgcaaggcggtgccctgttgtacgttaacgattcgcgcaccccgtgggcgaactcgaactatcgcttgctgaaccataccgctaccaatcaaaaaggcactattgacaaatctgtcctggacgagcagagcgacccgaaccacatgggcggtttcgattttctgctggcgaacgacgtcgacctgagcaacccggtggtgcaggccgaacaactgaaccagattcactacctgatgaattggggtagcatcgtgatgggtgataaagatgcgaactttgacggcattcgtgtcgatgcggtcgataacgtggacgccgacatgttgcagctgtacacgaactactttcgtgagtactacggcgttaacaagagcgaagcaaatgccctggcgcatatcagcgttctggaagcgtggagcctgaatgacaatcactataacgataagacggacggtgcggccctggcaatggagaataaacaacgtctggcgctgctgttcagcctggcgaaaccgatcaaagagcgtacgccggctgtgagcccactgtataacaacaccttcaatactacgcagcgtgacgagaaaacggactggattaacaaagacggtagcaaagcgtataacgaggatggtaccgtcaagcaatcgaccattggtaagtacaatgagaagtatggcgacgcaagcggtaattacgtgttcattcgtgcccacgacaacaatgttcaagacatcatcgccgaaatcatcaagaaagagatcaaccctaagagcgacggtttcaccatcaccgacgcagagatgaagaaggcctttgaaatctacaacaaggacatgttgagcagcgataagaagtatactctgaacaacattccggctgcgtacgcggtgatgttgcagaatatggaaaccatcacgcgtgtttactatggtgatctgtataccgataatggcaactacatggaaacgaaaagcccgtactatgacaccattgttaatctgatgaagaatcgcatcaagtatgtgtctggcggtcaagcgcagcgttcttactggctgccgaccgatggtaagatggacaatagcgatgtggaactgtaccgcaccaacgaggtatacgcttctgtgcgctatggtaaagacattatgaccgccgatgataccgagggttccaagtactcccgtacgagcggccaagttaccttggtggcaaacaacccgaaattgaccctggaccaaagcgcgaaactgaaagtggagatgggtaagatccacgcaaatcaaaagtaccgtgcactgattgtcggtaccgccgacggtatcaagaatttcaccagcgatgcggatgcgattgcagcaggctatgttaaagagactgatagcaatggtgtgctgacgtttggtgcgaacgacattaaaggctatgaaacgtttgacatgagcggtttcgttgcggtgtgggtgcctgtgggtgctagcgatgatcaggatatccgtgtcgcgccgagcaccgaggcaaagaaagaaggtgagctgacgttgaaagcgaccgaggcctatgacagccagttgatttacgaaggtttcagcaatttccaaaccattccagacggttccgatccgagcgtctacaccaatcgcaaaatcgcggaaaacgttgatctgttcaaaagctggggtgtgaccagcttcgaaatggcaccgcaattcgttagcgcggacgatggtacgttcttggacagcgttatccaaaatggctatgcgttcgccgatcgttatgacttggcgatgagcaaaaacaacaaatacggcagcaaagaggatctgcgcgacgccctgaaagcgctgcataaagcgggtattcaagccatcgctgactgggttccggaccagatctaccagctgccgggtaaagaagtcgttaccgcgacccgcaccgatggcgctggccgtaagatcgcggatgcaattatcgatcatagcttgtatgtggccaatactaaaagctccggtaaggattaccaggcgaaatatggtggtgaatttctggctgagctgaaggccaaatacccggagatgttcaaggtcaacatgattagcaccggcaaacctattgatgactctgtcaaattgaaacaatggaaggcagagtatttcaatggcactaacgtcctggaacgtggtgttggttacgtgctgagcgacgaggcgaccggtaaatacttcaccgttacgaaggacggcaatttcatcccgctgcaactgaccggtaatgagaaggttgtgacgggtttttctaatgacggtaagggcattacctacttcggtacctcgggtacccaggcaaagagcgcattcgtgacgtttaacggtaacacctactactttgatgcacgcggccacatggtgacgaacggcgagtacagcccgaacggcaaggatgtttatcgcttcctgccgaatggcatcatgctgtccaatgcgttttacgtcgatgcaaatggtaatacttacctgtacaacagcaagggtcagatgtataagggcggttataccaagttcgacgttactgaaacggacaaggacggtaaagagagcaaagtagtgaagtttcgttatttcacgaacgaaggcgtcatggcgaaaggtgtcaccgttattgatggctttacccagtatttcggtgaagatggctttcaagcgaaggacaagctggtgacctttaagggcaaaacctactattttgacgcgcacacgggcaacgccatcaagaacacctggcgtaatatcgacggtaagtggtatcattttgatgcgaacggtgtggcggcgaccggcgcacaggtcattaatggtcaaaaactgtactttaatgaggacggtagccaagtcaaaggtggcgtcgtcaagaatgcagatggcacctatagcaaatacaaagagggctccggtgagctggttaccaacgagttctttaccacggatggtaacgtctggtactatgctggtgcgaatggcaagaccgttaccggtgcacaggttatcaacggccagcacctgtacttcaatgcggatggctctcaagtgaagggcggtgtcgtcaaaaacgcggacggtacgtactccaaatacgatgccgcgaccggtgaacgtctgaccaatgagtttttcacgactggtgacaacaattggtactacatcggcgccaacggtaagacggttacgggcgaagtgaaaattggcgacgatacgtactacttcgcaaaagatggtaaacaggtgaaaggtcagacggtttccgctggtaatggccgcatcagctactattacggtgactctggtaaacgtgcggttagcacgtgggttgaaattcaaccgggcgtgtatgtctattttgataagaatggcctggcatatccaccgcgcgttttgaattaa

SEQ ID NO: 34 - protein, 1341 aa, Streptococcus salivarius JIM8777
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYTSTDKQETLNVAAKDIQVKIEQKIQAEKSTQWLRETISAFVKTQPQWNKETENYSKGGGEDHLQGGALLYVNDSRTPWANSNYRLLNHTATNQKGTIDKSVLDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKKAFEIYNKDMLSSDKKYTLNNIPAAYAVMLQNMETITRVYYGDLYTDNGNYMETKSPYYDTIVNLMKNRIKYVSGGQAQRSYWLPTDGKMDNSDVELYRTNEVYASVRYGKDIMTADDTEGSKYSRTSGQVTLVANNPKLTLDQSAKLKVEMGKIHANQKYRALIVGTADGIKNFTSDADAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANTKSSGKDYQAKYGGEFLAELKAKYPEMFKVNMISTGKPIDDSVKLKQWKAEYFNGTNVLERGVGYVLSDEATGKYFTVTKDGNFIPLQLTGNEKVVTGFSNDGKGITYFGTSGTQAKSAFVTFNGNTYYFDARGHMVTNGEYSPNGKDVYRFLPNGIMLSNAFYVDANGNTYLYNSKGQMYKGGYTKFDVTETDKDGKESKVVKFRYFTNEGVMAKGVTVIDGFTQYFGEDGFQAKDKLVTFKGKTYYFDAHTGNAIKNTWRNIDGKWYHFDANGVAATGAQVINGQKLYFNEDGSQVKGGVVKNADGTYSKYKEGSGELVTNEFFTTDGNVWYYAGANGKTVTGAQVINGQHLYFNADGSQVKGGVVKNADGTYSKYDAATGERLTNEFFTTGDNNWYYIGANGKTVTGEVKIGDDTYYFAKDGKQVKGQTVSAGNGRISYYYGDSGKRAVSTWVEIQPGVYVYFDKNGLAYPPRVLN

SEQ ID NO: 35 - DNA, 3996 bp, Streptococcus salivarius SK126
atggtcgacggcaaatactactacgtgaaagaggatggcagctacaaaacgaacttcgcagtttccgtcaacggccaactgctgtatttcggcaaggatggcgcgctgacgtccaccagcacccatagctttacgccaggcactaccaatctggttgatgcgttcagctcccataaccgcgcctacgactccaaaaaggagagcttcgaactggtggatggttatctgacgccgaactcttggtatcgtccggtcactatcctggaaaatggtgaaaaatggcgtgttagcaccgagaaggactttcgcccgttgttgatggcctggtggccggatgtcgacacgcaagttgcctatctgaacaccttttctaaacacttcaacctgaacgcgacgtactctacttctcagagccaaagcgagctgaatgcggcagctaaaaccatccaaatcaaaatcgaacaggagattagcgcgaaaaagagcacggagtggctgcgccaggcaattgagtcctttgtcaaggagcaggatcagtggaacaccacgaccgagaactacaccctggcggatcatttgcagggcggtgcgctgctgtatgtgaacaatgacaagacgccgtgggcgaacagcgactatcgtctgctgaaccgtactccgagcaaccaggacggcagcctgaacggtactggccgttatctgggtggttacgagtttctgctggcgaatgacgtggacaatagcaatccggtggtccaggctgagcagctgaatcaaattcactatctggtcaactggggcagcattgtcatgggtgacaaggacgcgaatttcgacggcattcgtgttgacgccgttgacaatgtggacgccgatctgttgcaggtttacacgaactacttccgtgcggcgtttggtgtggataaaagcgaagcgaacgcactggcccacatcagcattctggaggcgtgggatctgaacgacaatgcgtacaaccagaaacatgacggtgcggccttggcaatggataacaacctgcgttacgcgatcatgggtgcactgtatggtagcggtagctcgctgaaagatctgattaccagcagcctgaccgaccgtacgaataactccaaatatggtgatacccaagcaaactacatcttcgcccgtgctcatgataatctggtccaggacattattcgtgacatcgtgcagaaagagatcaatccgaagagcgacggctacacgatgaccgatgcggagctgaagcgtgcgtttgaaatctacaacgaggatatgaaaaaggccgaaaaacgctacactatcaacaacatcccggcagcgtatgcactgattttgcagaacatggaacaggttactcgtgtgtactacggtgatctgtataccgacaatggtcagtacatggcgaccaaaagcccgtactacgacgcgattacgaccctgctgaaaaatcgtatgaagtatgtgagcggcggtcagagcatgaaagttgacactttcaacggtaaagaaattctgtcgtctgttcgttacggtaaggacatcatgaccgcggaccaaacgaccggtgtcgcagaaaccagcaagcacagcggcatgctgaccctgatcgccaataaccaggatttttctctgggcgatggcaccttgaaagtgaacatgggcaagctgcacgcgaaccaggcgtatcgcccgctgctgctgggcacggataagggcatcgttacctatgaaaatgacgcggctgcggcaggcaaaatcaagtacacggacgcagagggtaatctgaccttcagcggtgacgagatcaagggctatcgcaccgtggacatgcgcggctacctgggtgtgtgggtcccggtcggcgcaccggacaatcaagacattcgcgttaagggtagcgataagaaactggacaagactttcagcgcaaccgaagctctggatagccaggtgatttacgaaggttttagcaactttcaggacttcgtggaaaaagacagccagtacaccaacaagctgattgcggaaaacgcggaactgtttaagagctggggtattactagctttgaaatggcccctcagtttgtcagcgcagacgatcgtaccttcctggatagcgttatccaaaacggttatgcgtttaccgatcgttacgatctggccatgtctaagaataacaagtatggcagcaaagaagatctgcgtgatgcgctgaaggcgctgcacaagcagggcattcaagcaattgccgactgggttccggatcaactgtaccaactgccgggtcaagaggttgtcaccgctacccgtgcaaatagctacggcaccccgaaggccaatgcctacattaacaatacgctgtatgttgccaatagcaagagcagcggtaaagacttccaggctcaatacggtggcgagttcctggatgaattgcagaagaagtacccgcagttgttcgaggatgtgatgatcagcacgggtaaaaagattgacccgagcgtgaaaatcaagcagtggagcgccaaatacatgaatggcaccaacattctgggtcgtggcaaccgttacgttctgtcgaatgacgccaccggtcgctattatcaagtgaccgacaacggcattttcttgccgaagccgctgacggatcagggtggtaagaccggcttctattacgatggtaagggcatggcctatttcgacaattccggctttcaagcgaaaaatgcgttcatcaagtacgcgggtaactactactacttcgataaagagggctatatgctgacgggccgtcaagatattgacagcaagacgtatttctttctgccgaatggtatccaactgcgtgatagcatttaccaacaagatggcaagtactactattttggtagcttcggcgaacaatacaaagacggttatttcgtctttgacgtgccaaaagagggcaccagcgaaaccgaggctaagttccgctacttttctccgacgggtgagatggcagtgggtttgacctatgcgggtggtggtctgcaatactttgatgagaacggtttccaggcgaagggtacgaagtatgttacgccggatggtaagttgtatttcttcgacaagaatagcggcaacgcgtacaccaatcgttgggcggagatcgatggtatttggtacgagtttaatgaccaaggttacgcgcaggcgaagaaaggtgagttttacaccacggatggtagcacgtggttttaccgcgacgcagcaggtaaaaacgttaccggtgccctgaccctggacggtcacgagtattactttcgtgcgaacggtgcgcaggtgaaaggcgagttcgtcaccgaaaacggtaagattagctattacaccgttgataacggttacaaggtaaaagacaagttcttcgaagtcaatggtaagtggtatcacgctgataaggacggtaatttggcgacgggtcgtcagaccatcgaccatctgaattactacttcaacgcggacggctcccaggttaagtccgatttcttcactctggatggtggtaaaacctggtattatgccaaagacaacggtgagattgtgaccggtgcgtactcggtgcgtggcaagaactattacttcaaagaggacggtagccaagttaagggcgatttcgtcaaaaatgcggacggttccctgagctattatgacaaggatagcggcgaacgtctgaacaaccgtttcttgaccacgggtaacaatgtctggtattactttaaggatggtaaagcggtcacgggtcgccagaacatcgacggtaaggagtactactttgatcacctgggtcgtcaagtcaaaggctccccgattagcactccgaagggcgttgagtattatgagtctgtgctgggtgagcgtgtcaccaacacctggatcaccttccaagacggcaaaaccgtgttctttgatgaaaatggctacgcggactttgataagtaa

SEQ ID NO: 36 - protein, 1331 aa, Streptococcus salivarius SK126
MVDGKYYYVKEDGSYKTNFAVSVNGQLLYFGKDGALTSTSTHSFTPGTTNLVDAFSSHNRAYDSKKESFELVDGYLTPNSWYRPVTILENGEKWRVSTEKDFRPLLMAWWPDVDTQVAYLNTFSKHFNLNATYSTSQSQSELNAAAKTIQIKIEQEISAKKSTEWLRQAIESFVKEQDQWNTTTENYTLADHLQGGALLYVNNDKTPWANSDYRLLNRTPSNQDGSLNGTGRYLGGYEFLLANDVDNSNPVVQAEQLNQIHYLVNWGSIVMGDKDANFDGIRVDAVDNVDADLLQVYTNYFRAAFGVDKSEANALAHISILEAWDLNDNAYNQKHDGAALAMDNNLRYAIMGALYGSGSSLKDLITSSLTDRTNNSKYGDTQANYIFARAHDNLVQDIIRDIVQKEINPKSDGYTMTDAELKRAFEIYNEDMKKAEKRYTINNIPAAYALILQNMEQVTRVYYGDLYTDNGQYMATKSPYYDAITTLLKNRMKYVSGGQSMKVDTFNGKEILSSVRYGKDIMTADQTTGVAETSKHSGMLTLIANNQDFSLGDGTLKVNMGKLHANQAYRPLLLGTDKGIVTYENDAAAAGKIKYTDAEGNLTFSGDEIKGYRTVDMRGYLGVWVPVGAPDNQDIRVKGSDKKLDKTFSATEALDSQVIYEGFSNFQDFVEKDSQYTNKLIAENAELFKSWGITSFEMAPQFVSADDRTFLDSVIQNGYAFTDRYDLAMSKNNKYGSKEDLRDALKALHKQGIQAIADWVPDQLYQLPGQEVVTATRANSYGTPKANAYINNTLYVANSKSSGKDFQAQYGGEFLDELQKKYPQLFEDVMISTGKKIDPSVKIKQWSAKYMNGTNILGRGNRYVLSNDATGRYYQVTDNGIFLPKPLTDQGGKTGFYYDGKGMAYFDNSGFQAKNAFIKYAGNYYYFDKEGYMLTGRQDIDSKTYFFLPNGIQLRDSIYQQDGKYYYFGSFGEQYKDGYFVFDVPKEGTSETEAKFRYFSPTGEMAVGLTYAGGGLQYFDENGFQAKGTKYVTPDGKLYFFDKNSGNAYTNRWAEIDGIWYEFNDQGYAQAKKGEFYTTDGSTWFYRDAAGKNVTGALTLDGHEYYFRANGAQVKGEFVTENGKISYYTVDNGYKVKDKFFEVNGKWYHADKDGNLATGRQTIDHLNYYFNADGSQVKSDFFTLDGGKTWYYAKDNGEIVTGAYSVRGKNYYFKEDGSQVKGDFVKNADGSLSYYDKDSGERLNNRFLTTGNNVWYYFKDGKAVTGRQNIDGKEYYFDHLGRQVKGSPISTPKGVEYYESVLGERVTNTWITFQDGKTVFFDENGYADFDK

SEQ ID NO: 37 - DNA, 3918 bp, Streptococcus salivarius SK126
atgattgacggcaaacagtattatgtagagaacggtgtggttaagaagaatacggcgattgaactggatggccgtctgtattactttgacgaaaccggtgcaatggttgatcaatctaagccgctgtatcgcgcggatgcaatcccgaacaactctatctacgcagtttacaaccaggcttacgacaccagcagcaagagctttgaacacctggacaactttctgacggccgatagctggtaccgtccgaagcagattttgaaagacggcaagaattggaccgcctcgacggagaaggactatcgtcctttgctgatgacgtggtggccggataaagtcacgcaagtcaactacctgaactatatgtcccaacagggctttggtaacaagacctacaccacggatatgatgagctacgacctggcggcagcggcggaaacggttcagcgtggcatcgaagagcgtattggtcgtgagggtaatacgacgtggctgcgtcagttgatgagcgacttcatcaaaacccagccgggctggaatagcgagagcgaagataatctgctggtcggtaaggatcatctgcaaggtggtgcactgacgtttctgaacaatagcaccacgagccatgcgaacagcgatttccgcctgatgaatcgtaccccgacgaaccagaccggcacccgcaaataccacatcgatcgtagcaatggtggctacgaactgctgctggcgaacgacatcgacaatagcaatccggccgtccaagcggaacagctgaactggctgcattacatcatgaacatcggctctatcctgggcaatgacccaagcgcgaattttgatggcgtccgtatcgatgcagttgacaatgtggatgcggacttgttgcaaattgcgtctgactactttaaggaaaagtaccgtgttgccgataacgaggcaaacgctattgcgcacctgtcgattctggaggcatggtcctacaatgatcatcaatacaacaaagacacgaagggcgctcaactgagcattgataatccgctgcgtgagactttgctgacgaccttcctgcgcaagtctaactaccgtggttccctggagcgtgtgatcaccaactcgttgaacaaccgtagcagcgaacagaagcacacgccgcgtgacgccaactacatttttgtgcgtgctcacgacagcgaagttcaagcggtgctggcaaacatcatctctaaacagatcaacccgaaaaccgacggttttacctttacgatggatgagctgaagcaggcgtttgagatttacaacgcagacatgcgtaaggcggataagaagtacacgcagtacaacattccggcagcttacgccaccatgctgaccaataaggatagcatcacccgtgtgtactatggtgatttgtttaccgacgacggtcaatacatggcggagaaaagcccgtactataacgcaattgacgccctgctgcgtgctcgcatcaaatacgtcgcgggtggtcaggacatgaaggtgaccaaattgaacggctatgagatcatgtcctccgttcgctacggtaaaggcgcagaggaagctaatcagctgggcaccgcagaaacccgcaatcaaggcatgctggtcctgaccgcgaatcgcccagacatgaagctgggtacgaatgatcgcctggtcgtcaatatgggtgcagcccacaagaatcaggcgtatcgtccgctgctgctgtccaagtccaccggcttggcaacctacctgaaagacagcgacgtccctgcgggcctggtgcgttacacggacaatcaaggtaatctgaccttcacggcggacgacatcaccggccatagcaccgtagaggtgagcggttacctggcggtttgggtgccggtgggtgcgagcgagaaccaagatgcgcgcacgaaagcgagcacgacgaaaaagggcgaacaagtttttgaaagctccgcagcgctggatagccaggtcatctatgagggtttctccaacttccaggattttgttaagaccccttcccagtacacgaatcgcgttatcgcacagaacgcgaagcgctttaaggagtggggtatcaccagctttgagttcgcgcctcaatatgttagcagccaagacggtacctttctggatagcattattgagaacggctacgcgttcgaggaccgttacgatatcgcgatgagcaaaaacaacaagtacggcagcctgaaggatctgatggacgcgctgcgtgcactgcacgcggagggtatcagcgccattgctgactgggttccggaccaaatctataacctgccgggtaaggaagttgtaaccgcaagccgcacgaatagctacggtacgccgcgtccgaacgcggaaatctataacagcctgtatgcggcgaaaacgcgtacgtttggcaatgattttcagggtaaatacggtggcgcgtttctggatgaactgaaagcaaagtacccggcgatcttcgagcgtgtgcaaatttcgaatggtcgtaagctgactaccaatgagaaaatcacgcaatggagcgcgaagtactttaatggcagcaacattcaaggtaccggtgcgcgttacgttctgcaagataatgccacgaaccagtatttcaacctgaaggccggtcaaacctttctgccaaagcagatgaccgagattaccgcaacgggcttccgtcgtgtcggtgacaaagtgcaatacctgtccacgtccggctacctggcgaagaatacctttatccagattggtgcgaaccagtggtattacttcgacaagaatggcaacatggtgaccggtgagcaagtgattgatggtaaaaagtatttcttcctggataacggtctgcaactgcgtcatgtcttgcgtcaaggttctgacggtcacgtgtattactacgatccgaaaggcgtccaggcgtttaatggtttctatgactttgcgggtccgcgccaagatgtccgttatttcgacggtaatggtcagatgtaccgtggtctgcatgatatgtatggtaccacgttctactttgatgaaaagacgggtatccaggctaaggataagtttatccgtttcgccgacggccgtacccgttactttattccggacaccggcaatttggctgtgaatcgcttcgctcagaatccggaaaacaaggcgtggtactacctggacagcaacggttatgcagtgacgggtttgcagaccattaatggcaaacaatactatttcgacaacgagggccgtcaggtcaagggccacttcgttactatcaacaatcagcgctacttcttggacggtgactcgggtgagatcgcacgtagccgcttcgtgacggagaacaacaaatggtactatgtggatggtaacggtaaattggtcaagggtgcacaagtcatcaacggtaaccactattacttcaataatgattattctcaggtgaaaggtgcttgggccaatggccgctactacgacggcgatagcggccaggcggtcacgaatcgtttcgtgcaggtcggtgcaaaccagtgggcctatctgaatcagaacggtcagaaggttgtgggcttgcaacacatcaatggcaagctgtactactttgaaggcaacggtgtccaagcaaaaggcaagctgctgacctataagggtaagaaatactacttcgatgctaacagcggtgaggcagtcaccaaccgctttattcaaatctctcgcggtgtttggtactatttcaatgcgagcggtcaagcagtgaccggcgagcaagttatcaatggtcaacacctgtacttcgacgcaagcggtcgccaggttaaaggccgctatgtctggattaaaggccagcgccgttattacgacgcgaacactggtgcctgggtacgtaatcgttaa

SEQ ID NO: 38 - protein, 1305 aa, Streptococcus salivarius SK126
MIDGKQYYVENGVVKKNTAIELDGRLYYFDETGAMVDQSKPLYRADAIPNNSIYAVYNQAYDTSSKSFEHLDNFLTADSWYRPKQILKDGKNWTASTEKDYRPLLMTWWPDKVTQVNYLNYMSQQGFGNKTYTTDMMSYDLAAAAETVQRGIEERIGREGNTTWLRQLMSDFIKTQPGWNSESEDNLLVGKDHLQGGALTFLNNSTTSHANSDFRLMNRTPTNQTGTRKYHIDRSNGGYELLLANDIDNSNPAVQAEQLNWLHYIMNIGSILGNDPSANFDGVRIDAVDNVDADLLQIASDYFKEKYRVADNEANAIAHLSILEAWSYNDHQYNKDTKGAQLSIDNPLRETLLTTFLRKSNYRGSLERVITNSLNNRSSEQKHTPRDANYIFVRAHDSEVQAVLANIISKQINPKTDGFTFTMDELKQAFEIYNADMRKADKKYTQYNIPAAYATMLTNKDSITRVYYGDLFTDDGQYMAEKSPYYNAIDALLRARIKYVAGGQDMKVTKLNGYEIMSSVRYGKGAEEANQLGTAETRNQGMLVLTANRPDMKLGTNDRLVVNMGAAHKNQAYRPLLLSKSTGLATYLKDSDVPAGLVRYTDNQGNLTFTADDITGHSTVEVSGYLAVWVPVGASENQDARTKASTTKKGEQVFESSAALDSQVIYEGFSNFQDFVKTPSQYTNRVIAQNAKRFKEWGITSFEFAPQYVSSQDGTFLDSIIENGYAFEDRYDIAMSKNNKYGSLKDLMDALRALHAEGISAIADWVPDQIYNLPGKEVVTASRTNSYGTPRPNAEIYNSLYAAKTRTFGNDFQGKYGGAFLDELKAKYPAIFERVQISNGRKLTTNEKITQWSAKYFNGSNIQGTGARYVLQDNATNQYFNLKAGQTFLPKQMTEITATGFRRVGDKVQYLSTSGYLAKNTFIQIGANQWYYFDKNGNMVTGEQVIDGKKYFFLDNGLQLRHVLRQGSDGHVYYYDPKGVQAFNGFYDFAGPRQDVRYFDGNGQMYRGLHDMYGTTFYFDEKTGIQAKDKFIRFADGRTRYFIPDTGNLAVNRFAQNPENKAWYYLDSNGYAVTGLQTINGKQYYFDNEGRQVKGHFVTINNQRYFLDGDSGEIARSRFVTENNKWYYVDGNGKLVKGAQVINGNHYYFNNDYSQVKGAWANGRYYDGDSGQAVTNRFVQVGANQWAYLNQNGQKVVGLQHINGKLYYFEGNGVQAKGKLLTYKGKKYYFDANSGEAVTNRFIQISRGVWYYFNASGQAVTGEQVINGQHLYFDASGRQVKGRYVWIKGQRRYYDANTGAWVRNR

SEQ ID NO: 39 - DNA, 3933 bp, Streptococcus gallolyticus ATCC 43143
atgatcgacggcaaatactactatgttcaggcagatggcagcgttaagaagaatttcgcgattacggtcaacggtcagctgctgtactttgatgctgagactggcgctctgacgagcacgagcacttatagctttaccgaaggcctgaccaatctggtggataactttagcaagaacaatcaagcgtatgacagcacggagaaatcctttgagctggttgatggctacctgacggcgaacagctggtatcgtccgactaaagttttggagaatggcgaaacctgggttgacagcaccgaagagagcttccgtccactggtgatggcttggtggcctgacgtcgatacccagattaactacctgaacagcatgagcgaatactttggtttgaataagaagtattctgcatcggatagccaagcatctctgaatgtggcggctgaagcgatccaggtgaaaattgagcaggagattgcgcgtcgtggttcgaccgagtggttgcgtgaggtcattagctcttttgttacgacccaagataagtggaatatgaacagcgaagatcgcgacactgaccacctgcaaggtggcgcactgctgtatgtcaacagcgatctgactgagtgggccaatagcgattaccgcctgctgaaccgcgctccgacctatcaaactggtgaaactaagtaccacaaagccgaccgcacgggtggctacgacttcctgctggcgaatgatgttgacaatagcaatccggttgttcaggccgaacaactgaatcagctgtactacctgatgaactggggtaagattgtgttcggtgacgcagatgcaaacttcgatggcgtccgtgttgacgcggtggacaacgtggatgctgatctgttgcaaatctacacgaatctgtttgaagcggcctacggcgtcgataagaccgaagcacaagcgctggcgcatattagcatcttggaagcgtggagcttcaacgacccggactataatcacgacaccaacggtgcagcactggccatcgacaacggtctgcgtatggccttcctggatgctctgactcgtcctctggactcccgcactaatttggagagcctgattcacaacgatctgggcatgactgaccgtaccgtcgatagcgcgtatggtgatgctatgccgagctatgccttcgtccgtgcccacgactctgaagttcagggcatcattgcatctatcatcgccggtcagatcaatccgaaaacggacggttttacctttaccttggatgagctgcaaaaggcattcgaaatctacaacgccgacatgaactccgtgcacaagaagtatacccatttcaatatcccagcagcatacgctttgctgctgaccaacatggagagcgttccgcgtgtatactatggcgatttgttcaccgataacggtcagtacatggccgttaaaagcccgtactacgaccagatcaccgcgctgctgaagtctcgtatcaagtacgcggcaggcggtcaagccatgaatgtgcaatacccggatggtgcgggtgcgggtatcctgacttctgtgcgcttcggctatggcattatgacggcggatcaaaaagcgaccgacgacagcgttactaccagcggcattgtcaccattgtttccaacaacccgaacctgaaactgaatagcagcgacaaaattgcggtgcaagttggtctggcacacgcaggccaatactaccgtccgctgctgtctccgacggagaatggtctgcaagtgttcctgaatgattccgacaccgacatcaccaagctggtcgatgataacggttacatctatttcacgggtgatgagatcaaaggtttcgagactgtggacatgaatggcttcctgaccgtttgggttccggtgggtgcggcagccgatcaggatattcgcgtcaaggcgagcacggaagcgaagaaggatggtgagctgacctatgaaacctctgcggcgctggattctcaggtcatttttgaaggctttagcaactttcaagactttgttcaggacccaagccagtacaccaataaggtgattgcggagaatgcggatctgttcgcgagctggggcatcacgtctttcgagctggcaccgcagtatgttagcagcacggacggtacgttcctggacagcattattcagaacggttatgcttttacggatcgttatgacttggcgatgtctaagaacaataagtatggtagcgcagaagatttgcgcaatgcgattaaagcgctgcacgcacgcggtattcaagtgattgctgattgggtccctgaccagatttatgcgctgcctggtgaagagattgtgacggcgacccgtgttaatgactacggcgaagaacgtgaaggcgcgcaaatcaagaacaaaccgtatgcggcgaatacgaaaagctccggtgaggattaccaagcccaatacggtggcgagttcttggaatatctgcaagagaattacccggagttgtttgaaaaggtcatgattagcacgggtaagaccattgacccatcgacgaagatcaaggtctggaaagcggagtatttcaacggcacgaatattctgggtaagggtgccgattacgtcctgaacgatgcggccaccggcacctacttcaccgtaacggagaacggcgccttcctgccgaaacaaatgacgagcgataccgcccaaacgggtttctattatgatggcaccggcatgacgtactattctacctcgggttaccaagctaagtctagcttcgtgctgtacaacggcaaccgttactatttcgatgaaaacggtcacatggttacgggtatgcgcgatattgatggtcagacgtactactttctgccgaatggtatcgaactgcgtgacgcgatctatgaggacgcgaacggtaatcagtattactttggcaaatcgggtaaccgctacgcgggtcattactacgcctttgaaaccacgagcaccgttgacggtgtcaccaagaccactactaactggcgctattttgatgaaaacggcgttatggcacgcggcctggtgaaaatcggtaatgattatcaatactacgacgataacggcaatcagatcaagggtcaactggtgacggacaaggacggcaacacccgttactttaaagctgacagcggtgcaatggttacgggtgagtttgcactggtgaatggtggttggtactacttcgatgacaatggtgttgcagtcaaaggtgctcagaccattaacggtcaacagttgtacttcgacgagaatggtgtccaagcaaaaggtgtgttcgtgaccaatgaggatggcacccgtagctattacgacgccaagtccggtgagaagtttgttggcgacttctttacgaccggcgacaaccattggtactatgccgacgagaacggcaatttggcaacgggtagccaggttatccgtggtcagaagttgtattttgcagccgatggtttgcaggcgaaaggtatctttaccaccgacgccgaaggtaaccgccacttctacgacccggactccggcgatctggcggaaaacaagtttatcgcggatggtgacgactggtactattttgacgaaacgggtcatgttgttaccggcgagcaagtgatcaacggccaacagctgtatttcgacgaaaatggcgttcaggcgaagggtgttttcgtgaccgatgataatggtaataagcgttactatgatgcacagacgggtgagatggtggtgaaccagacgctgacggtggatggtgtggaatatacctttggtgcggatggcgtcgcggtggttaatgcacaagatagcgacgaacaaagcgaaagcacggatgaaacgcaagtgaccagcgatgacgcgacggttgcaaagacggaaaccagctctgctgaataa

SEQ ID NO: 40 - protein, 1310 aa, Streptococcus gallolyticus ATCC 43143
MIDGKYYYVQADGSVKKNFAITVNGQLLYFDAETGALTSTSTYSFTEGLTNLVDNFSKNNQAYDSTEKSFELVDGYLTANSWYRPTKVLENGETWVDSTEESFRPLVMAWWPDVDTQINYLNSMSEYFGLNKKYSASDSQASLNVAAEAIQVKIEQEIARRGSTEWLREVISSFVTTQDKWNMNSEDRDTDHLQGGALLYVNSDLTEWANSDYRLLNRAPTYQTGETKYHKADRTGGYDFLLANDVDNSNPVVQAEQLNQLYYLMNWGKIVFGDADANFDGVRVDAVDNVDADLLQIYTNLFEAAYGVDKTEAQALAHISILEAWSFNDPDYNHDTNGAALAIDNGLRMAFLDALTRPLDSRTNLESLIHNDLGMTDRTVDSAYGDAMPSYAFVRAHDSEVQGIIASIIAGQINPKTDGFTFTLDELQKAFEIYNADMNSVHKKYTHFNIPAAYALLLTNMESVPRVYYGDLFTDNGQYMAVKSPYYDQITALLKSRIKYAAGGQAMNVQYPDGAGAGILTSVRFGYGIMTADQKATDDSVTTSGIVTIVSNNPNLKLNSSDKIAVQVGLAHAGQYYRPLLSPTENGLQVFLNDSDTDITKLVDDNGYIYFTGDEIKGFETVDMNGFLTVWVPVGAAADQDIRVKASTEAKKDGELTYETSAALDSQVIFEGFSNFQDFVQDPSQYTNKVIAENADLFASWGITSFELAPQYVSSTDGTFLDSIIQNGYAFTDRYDLAMSKNNKYGSAEDLRNAIKALHARGIQVIADWVPDQIYALPGEEIVTATRVNDYGEEREGAQIKNKPYAANTKSSGEDYQAQYGGEFLEYLQENYPELFEKVMISTGKTIDPSTKIKVWKAEYFNGTNILGKGADYVLNDAATGTYFTVTENGAFLPKQMTSDTAQTGFYYDGTGMTYYSTSGYQAKSSFVLYNGNRYYFDENGHMVTGMRDIDGQTYYFLPNGIELRDAIYEDANGNQYYFGKSGNRYAGHYYAFETTSTVDGVTKTTTNWRYFDENGVMARGLVKIGNDYQYYDDNGNQIKGQLVTDKDGNTRYFKADSGAMVTGEFALVNGGWYYFDDNGVAVKGAQTINGQQLYFDENGVQAKGVFVTNEDGTRSYYDAKSGEKFVGDFFTTGDNHWYYADENGNLATGSQVIRGQKLYFAADGLQAKGIFTTDAEGNRHFYDPDSGDLAENKFIADGDDWYYFDETGHVVTGEQVINGQQLYFDENGVQAKGVFVTDDNGNKRYYDAQTGEMVVNQTLTVDGVEYTFGADGVAVVNAQDSDEQSESTDETQVTSDDATVAKTETSSAE

SEQ ID NO: 41 - DNA, 3804 bp, Streptococcus mutans
atggtcaatggcaaatactactactacaaagaggacggtacgttgcagaagaactacgcactgaacattaacggcaagacctttttctttgacgagactggcgccctgagcaataacaccctgccgagcaagaaaggtaacatcaccaataacgacaataccaatagcttcgcgcaatacaatcaggtgtattcgacggatgcagcgaacttcgaacatgtcgatcactacctgacggcggagtcctggtatcgcccgaagtatattctgaaagatggcaagacgtggactcagtccacggagaaagattttcgcccgttgttgatgacctggtggccggatcaggaaacccagcgtcagtatgtaaactatatgaatgcccagctgggtattcaccagacctacaacacggcgaccagcccgttgcaactgaatctggcggcacagacgatccagaccaagattgaagagaagatcacggcggagaagaacactaattggctgcgtcaaacgatttcggcctttgtcaaaacccagagcgcgtggaactcggacagcgaaaaaccgtttgacgatcatctgcaaaagggtgcactgctgtactctaacaatagcaagttgacctctcaagctaatagcaactaccgtattctgaaccgtaccccaaccaaccaaaccggcaagaaagatccgcgttataccgctgaccgtaccatcggtggttatgagttcttgctggcgaacgatgtggataatagcaatcctgttgttcaagcggaacagctgaactggctgcacttcctgatgaactttggcaatatctatgcaaacgaccctgacgccaactttgacagcatccgtgtagacgccgtggacaacgtggatgcagatttgttgcaaatcgctggtgactatctgaaggctgcaaagggcatccataagaacgacaaagcagcgaacgaccacctgtcgatcctggaagcatggagctataatgacaccccgtatctgcacgacgacggtgacaacatgatcaatatggacaaccgtctgcgtctgagcctgctgtatagcctggcgaagccgttgaaccagcgttcgggcatgaacccgctgatcacgaacagcctggttaaccgtaccgatgacaacgcagaaaccgcagcggtcccgagctacagctttatccgtgcacacgatagcgaggttcaagacctgattcgtaacattattcgtgctgagattaatccgaacgtcgtcggttatagcttcacgatggaagagatcaagaaggcctttgagatttacaacaaggatctgctggcgacggaaaagaaatacacccactataacaccgcgctgagctacgcgctgctgctgaccaataagagcagcgttccgcgtgtgtattacggtgatatgtttactgacgacggtcagtacatggcacataaaacgatcaactacgaggctatcgaaacgctgttgaaggcgcgcattaagtacgtgtctggtggccaagcgatgcgtaatcaacaggtgggtaatagcgaaatcattacgagcgtccgctatggcaagggcgcactgaaagcgacggataccggcgatcgtaccacgcgcaccagcggcgttgcggttattgaaggcaataacccgagcctgcgcttgaaggcgagcgaccgcgtcgttgttaacatgggtgcagcacacaagaaccaggcatatcgtccgctgttgctgaccactgataatggcatcaaagcgtatcacagcgatcaggaagctgcgggcctggtgcgctataccaatgatcgtggtgaattgatcttcacggcagctgacattaaaggttatgcaaatccgcaagtcagcggttatctgggcgtctgggtgccggtcggcgcagcggctgatcaagacgtgcgtgtggccgcgagcaccgcgccatcgaccgacggtaaaagcgtgcaccagaatgcggcgctggacagccgtgtcatgtttgagggttttagcaactttcaagcctttgcaacgaagaaagaagagtacaccaacgtcgtcatcgcgaagaacgtcgataagttcgcggaatggggcgttaccgatttcgaaatggcaccgcagtatgtgtctagcaccgatggctcgtttctggattccgtgatccaaaatggttatgcatttaccgaccgctatgacctgggcattagcaagccgaataagtatggtacggcggatgatctggttaaagcgatcaaggcgctgcattctaaaggtattaaggttatggccgactgggttccagatcagatgtatgctttcccggaaaaagaagtggtgacggccacccgcgtggacaaatatggtacgccggtcgcgggcagccagatcaaaaacactctgtatgtcgtggatggcaaaagctccggtaaagatcagcaagcgaaatatggcggtgccttcctggaagagttgcaggcgaaatacccggaactgttcgcgcgtaagcagatcagcactggtgttccgatggacccgagcgtgaagattaaacaatggtccgcgaaatactttaacggcacgaacatcctgggtcgtggtgccggctacgtgctgaaagaccaggcaacgaatacgtactttagcttggtgtccgacaatacgtttctgccgaagtctctggtcaacccgaaccacggtacgagcagctctgtgaccggcctggtgttcgatggtaagggctacgtgtactactctaccagcggttaccaggccaagaatacgttcatcagcctgggtaacaactggtattacttcgacaataacggttacatggtcacgggtgcgcagagcatcaacggtgccaactactattttctgagcaacggcattcagctgcgtaatgcgatttacgacaatggcaataaggttctgagctactacggtaatgacggtcgtcgttatgagaatggctattacctgtttggccaacagtggcgctactttcaaaatggtattatggccgtcggtctgacccgtgtccacggtgcggtgcagtattttgacgccagcggcttccaagccaagggccagttcatcaccactgcggacggtaaactgcgttactttgaccgtgacagcggcaaccaaatcagcaatcgttttgttcgtaacagcaagggtgaatggtttttgttcgatcataacggcgtggcggttaccggcaccgttactttcaatggtcaacgtctgtactttaagccgaacggtgttcaggcaaagggtgagttcattcgcgacgcggatggtcacttgcgttactacgaccctaattccggtaatgaggttcgtaaccgtttcgtccgcaactctaagggcgaatggttcctgtttgaccacaatggcatcgcagtcaccggcgctcgtgtggtcaacggccaacgcttgtacttcaaaagcaatggcgtccaagctaagggtgagctgattaccgaacgtaagggccgtattaagtattatgatcctaacagcggtaacgaagtgcgtaaccgctacgtccgcaccagcagcggtaattggtactattttggtaacgatggttacgcgctgatcggctggcatgttgttgagggtcgtcgtgtgtactttgatgagaacggtgtctatcgttacgcgagccacgaccagcgtaatcattggaactacgactatcgtcgcgatttcggtcgtggtagcagctccgctatccgttttcgccatagccgtaacggctttttcgacaacttcttccgcttctaa

SEQ ID NO: 42 - protein, 1267 aa, Streptococcus mutans
MVNGKYYYYKEDGTLQKNYALNINGKTFFFDETGALSNNTLPSKKGNITNNDNTNSFAQYNQVYSTDAANFEHVDHYLTAESWYRPKYILKDGKTWTQSTEKDFRPLLMTWWPDQETQRQYVNYMNAQLGIHQTYNTATSPLQLNLAAQTIQTKIEEKITAEKNTNWLRQTISAFVKTQSAWNSDSEKPFDDHLQKGALLYSNNSKLTSQANSNYRILNRTPTNQTGKKDPRYTADRTIGGYEFLLANDVDNSNPVVQAEQLNWLHFLMNFGNIYANDPDANFDSIRVDAVDNVDADLLQIAGDYLKAAKGIHKNDKAANDHLSILEAWSYNDTPYLHDDGDNMINMDNRLRLSLLYSLAKPLNQRSGMNPLITNSLVNRTDDNAETAAVPSYSFIRAHDSEVQDLIRNIIRAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYAFPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFSLVSDNTFLPKSLVNPNHGTSSSVTGLVFDGKGYVYYSTSGYQAKNTFISLGNNWYYFDNNGYMVTGAQSINGANYYFLSNGIQLRNAIYDNGNKVLSYYGNDGRRYENGYYLFGQQWRYFQNGIMAVGLTRVHGAVQYFDASGFQAKGQFITTADGKLRYFDRDSGNQISNRFVRNSKGEWFLFDHNGVAVTGTVTFNGQRLYFKPNGVQAKGEFIRDADGHLRYYDPNSGNEVRNRFVRNSKGEWFLFDHNGIAVTGARVVNGQRLYFKSNGVQAKGELITERKGRIKYYDPNSGNEVRNRYVRTSSGNWYYFGNDGYALIGWHVVEGRRVYFDENGVYRYASHDQRNHWNYDYRRDFGRGSSSAIRFRHSRNGFFDNFFRF

SEQ ID NO: 43 - DNA, 3864 bp, Streptococcus mutans UA159
atgattgacggcaaatactactacatcggcagcgacggtcagccaaagaagaattttgcgttgacggttaacaataaagtcctgtattttgacaagaacacgggtgcgctgaccgacaccagccaatatcagttcaaacaaggtctgacgaagctgaacaacgactacacccctcacaatcagattgtcaactttgaaaatactagcctggaaactattgataactatgttactgccgactcttggtatcgtccgaaagacattctgaagaacggtaagacgtggaccgcgtcctctgagagcgatctgcgtccgctgctgatgtcctggtggcctgataagcagacccagatcgcatacctgaactacatgaaccaacaaggcttgggcactggcgagaactataccgctgatagctctcaagagagcctgaacctggcggcacaaaccgttcaagtcaaaatcgaaaccaagatcagccaaacgcaacagactcagtggctgcgtgacatcattaactctttcgttaagacgcaaccgaactggaatagccaaaccgagtctgacacgagcgctggtgaaaaagatcatttgcagggcggtgccctgctgtatagcaattcggacaaaaccgcatacgcaaatagcgactatcgtctgctgaaccgtaccccgaccagccagactggtaagccgaaatacttcgaggacaatagcagcggtggttacgacttcctgttggcaaacgatattgataattccaatccggtggtgcaggctgagcagctgaattggctgcattacctgatgaattacggtagcattgtcgcaaatgacccggaagcgaatttcgatggtgtccgtgttgacgcggtggataacgtgaacgcagacctgttgcagatcgcaagcgattatctgaaagcccattatggtgttgataagagcgagaagaatgcgatcaaccacctgagcatcctggaagcgtggtctgacaacgacccacagtataacaaagacaccaaaggtgcccagctgccgatcgacaacaaactgcgtctgtcgttgctgtacgcactgacccgtccgctggagaaggatgcaagcaacaaaaatgagattcgtagcggtctggagccggttattaccaattccctgaataatcgttccgctgagggcaagaactctgaacgcatggcgaattacatcttcatccgtgctcacgattctgaagttcaaacggtgatcgcaaagatcatcaaagcgcagattaacccgaaaacggatggcctgaccttcaccctggatgagctgaaacaggcgttcaaaatctataacgaggatatgcgccaggcgaagaagaagtatacccagagcaatatcccgacggcatacgccctgatgctgagcaataaggactccatcacgcgcctgtattacggtgatatgtacagcgatgatggccaatacatggcgaccaaatccccgtactacgatgcgattgacaccctgctgaaggcgcgcattaagtatgccgctggcggtcaggatatgaagatcacctacgttgagggtgacaaaagccacatggactgggactatacgggtgtcctgacgagcgttcgctacggcacgggcgcaaacgaagcgaccgaccagggcagcgaagctaccaagacgcaaggtatggccgtcatcacttctaacaacccgtccctgaagctgaatcagaacgacaaggtcattgtcaatatgggcaccgctcacaaaaatcaggaataccgtccgttgctgctgaccaccaaagacggtctgaccagctacaccagcgacgccgctgccaagagcctgtaccgtaaaacgaacgataagggcgagttggtgttcgatgcaagcgacattcagggctatctgaatccgcaagtgagcggttacctggctgtttgggtgcctgtgggtgcgagcgacaaccaggatgtgcgtgtcgcggccagcaataaagccaatgcgaccggccaagtctatgaaagcagcagcgcactggatagccaactgatttatgagggtttttccaactttcaggacttcgtcaccaaggattctgattacaccaataaaaagatcgcgcaaaatgtccagctgtttaagagctggggcgtcaccagctttgagatggctccgcaatacgtcagcagcgaggacggcagctttttggacagcattatccagaacggctatgcgttcgaggatcgttacgacctggcgatgagcaaaaacaacaaatacggctcccagcaggacatgatcaacgcggttaaggcgctgcataagagcggtatccaagtgatcgcggactgggtcccggatcaaatctacaatttgccgggtaaagaggtcgtcaccgcgacccgtgtgaacgactacggcgagtatcgcaaggactccgaaatcaaaaacaccctgtacgccgccaacaccaaaagcaacggtaaagattatcaagcaaagtacggtggcgcctttttgagcgagctggccgccaaatatccgagcatctttaaccgcactcagattagcaatggcaagaagatcgacccgtctgaaaagatcaccgcctggaaggccaaatacttcaatggtacgaacattttgggtcgcggcgttggttacgtcttgaaagacaatgccagcgacaagtattttgagctgaagggcaatcagacttatctgccgaagcaaatgacgaataaagaagcctcgactggtttcgttaatgacggcaatggtatgaccttttacagcacgagcggttatcaagcgaagaacagcttcgttcaggacgcaaaaggcaactggtactactttgacaacaatggccacatggtttacggtctgcaacatctgaacggcgaggtgcaatacttcctgagcaatggcgtgcaactgcgtgaatccttcttggaaaatgccgacggcagcaaaaactatttcggtcacctgggcaaccgttatagcaatggttactacagcttcgataatgatagcaaatggcgctatttcgatgcgagcggtgttatggcagtgggtctgaaaactattaacggtaacacccagtatttcgatcaagacggctaccaagtgaagggtgcatggattaccggcagcgatggtaagaagcgttacttcgacgacggtagcggcaatatggcagttaatcgctttgctaacgacaagaatggcgattggtattacctgaatagcgacggtattgcactggtgggtgttcagaccatcaacggcaaaacgtattactttggccaagatggtaaacaaatcaaaggcaaaatcattaccgataatggtaaactgaaatactttctggcgaacagcggtgagctggcgcgtaacatttttgcgaccgacagccagaacaactggtattacttcggctcggatggtgttgcggttacgggttcgcagacgattgcgggtaaaaagttgtactttgcgtccgacggtaaacaggtgaagggtagctttgttacttacaatggtaaagtgcactattaccatgcggacagcggcgaactgcaagtcaaccgtttcgaggcggataaagacggtaattggtactatctggacagcaacggtgaggcactgacgggtagccagcgtatcaatggtcaacgtgtgtttttcacccgcgagggcaaacaggttaagggtgatgtcgcgtatgatgaacgcggcttgctgcgctattacgacaaaaacagcggtaatatggtgtacaacaaggtggtcacgctggcgaacggtcgtcgtattggtattgaccgctggggtattgctcgctattactaa

SEQ ID NO: 44 - protein, 1287 aa, Streptococcus mutans UA159
MIDGKYYYIGSDGQPKKNFALTVNNKVLYFDKNTGALTDTSQYQFKQGLTKLNNDYTPHNQIVNFENTSLETIDNYVTADSWYRPKDILKNGKTWTASSESDLRPLLMSWWPDKQTQIAYLNYMNQQGLGTGENYTADSSQESLNLAAQTVQVKIETKISQTQQTQWLRDIINSFVKTQPNWNSQTESDTSAGEKDHLQGGALLYSNSDKTAYANSDYRLLNRTPTSQTGKPKYFEDNSSGGYDFLLANDIDNSNPVVQAEQLNWLHYLMNYGSIVANDPEANFDGVRVDAVDNVNADLLQIASDYLKAHYGVDKSEKNAINHLSILEAWSDNDPQYNKDTKGAQLPIDNKLRLSLLYALTRPLEKDASNKNEIRSGLEPVITNSLNNRSAEGKNSERMANYIFIRAHDSEVQTVIAKIIKAQINPKTDGLTFTLDELKQAFKIYNEDMRQAKKKYTQSNIPTAYALMLSNKDSITRLYYGDMYSDDGQYMATKSPYYDAIDTLLKARIKYAAGGQDMKITYVEGDKSHMDWDYTGVLTSVRYGTGANEATDQGSEATKTQGMAVITSNNPSLKLNQNDKVIVNMGTAHKNQEYRPLLLTTKDGLTSYTSDAAAKSLYRKTNDKGELVFDASDIQGYLNPQVSGYLAVWVPVGASDNQDVRVAASNKANATGQVYESSSALDSQLIYEGFSNFQDFVTKDSDYTNKKIAQNVQLFKSWGVTSFEMAPQYVSSEDGSFLDSIIQNGYAFEDRYDLAMSKNNKYGSQQDMINAVKALHKSGIQVIADWVPDQIYNLPGKEVVTATRVNDYGEYRKDSEIKNTLYAANTKSNGKDYQAKYGGAFLSELAAKYPSIFNRTQISNGKKIDPSEKITAWKAKYFNGTNILGRGVGYVLKDNASDKYFELKGNQTYLPKQMTNKEASTGFVNDGNGMTFYSTSGYQAKNSFVQDAKGNWYYFDNNGHMVYGLQHLNGEVQYFLSNGVQLRESFLENADGSKNYFGHLGNRYSNGYYSFDNDSKWRYFDASGVMAVGLKTINGNTQYFDQDGYQVKGAWITGSDGKKRYFDDGSGNMAVNRFANDKNGDWYYLNSDGIALVGVQTINGKTYYFGQDGKQIKGKIITDNGKLKYFLANSGELARNIFATDSQNNWYYFGSDGVAVTGSQTIAGKKLYFASDGKQVKGSFVTYNGKVHYYHADSGELQVNRFEADKDGNWYYLDSNGEALTGSQRINGQRVFFTREGKQVKGDVAYDERGLLRYYDKNSGNMVYNKVVTLANGRRIGIDRWGIARYY

SEQ ID NO: 45 - DNA, 4068 bp, Streptococcus gallolyticus ATCC BAA-2069
atgatcgacggcaaatactactatattgacgaggacggtaacgtaaagaagaatttcgcgattacggtggatggtcagttgctgtacttcgacgctgaaacgggtgctctgaccagcacgtccacctatagcttctccgagggcctgactaatctggtcgataacttcagcattaacaaccagtcctacgacagcaccgaagagtcgtttgagctgatcgacggttacctgaccgtcaatacttggtaccgtccgaccaaaattctggaaaacggtgaaacctgggtcgatagcaccgaaacggatttccgtccgctgctgatggcctggtggccggatgttgacacccaaattgactacttgaactacatgagcgattacttcgatctgggtacgacctatagcgctgacgattcccaagcgagcctgaatctggcagctgaggcggttcaggtgaaaattgaacaagaaattacccgtcaagagaacaccgcctggctgcgcgagatcatctctagctttgttaccacccaggataaatggaatatcaataccgagaatgagggcaccgaccatctgcaaggtggtgccctgctgtacgttaacagcgacttgactccgtgggcaaacagcgattatcgcctgctgaaccgcaccccgacgtaccagacgggtgagactaattactttaaagcagatcgtactggtggctacgaatttctgctggcaaatgacgtggataattctaacccggtcgttcaagccgaacagttgaaccagctgtactacttgatgaattggggctctattgtattcggtgatgacgacgccaattttgatggcgtgcgtgttgacgcggtggacaatgtgaacgctgacctgttgcagatttacacgaacctgttcgaagcggcgtatggtgttaacgagtctgaggcgcaggccctggctcacattagcatcctggaagcgtggtcttataacgacccggactacaaccacgacacgaatggcgctgccctggcaatcgacaatggtctgcgtctgagctttctgtactctttgacgcgccctacggacgagcgcagcggtttggagccactgatcacctctgagattggcctgaccgatcgttccgaggactctgcatacggtgacaccatgccgagctatgttttcgtccgtgcacatgacagcgaggttcagaccattattgcgagcattatcgcagaacagatcaacccggaaaccgatggctataccttcaccctggacgagctgaaccaggcgtttgagatttacaacgcggatatgaacagcgtggataaagagtatacgcattacaatatcccggctgcgtatagcctgctgctgaccaacatggaaagcgtcccgcgtgtttactacggtgacctgtatacggataacggtcagtacatggcgactaagagcccgtattatgaccagatcaccaccctgctgcaagcgcgcattcgttacgcggcgggtggccaatctatggctgttacgtactacacccctgcgtcgagcatgtctaccgacaatgcggatagcgtcctgaatgagactggtgtgctgacttctgtgcgttacggctatggcatcatgaccgccgaccaagaggccacggacgactccgttctgacctctggtattgttactattatcagcaacaaccctaatttgcagctggatgattccgaagtgattgcagtccaggttggtgtggcgcacgctggtcagtattatcgtccgctgttgtacccgacggcggatggtctgcaaagctacctgaacgatagcgataccgacattactaagctggtcgatgataatggttatatctactttacggcagatgagattaaaggctacgaaacggttgacatgaatggctacctgagcgtttgggtcccggttggtgcagacgagaatcaggacatccgtgtcagcgcagacaccagcgcgtacaccgagggtgaattgatctatcaagcaaccgcagcgctggatagccaagtgatctacgagggtttcagcaacttccaagatttcgttacctctaacagcgagtacactaacaagctgatcgcggagaacgtcgatctgtttaccagctggggcattacgagctttgagatggcgccacagtatgtgagcaccgatgacggtacttttctggatagcatcattcaaaacggttatgcatttgacgatcgctacgacctggcaatgagccagaataacaagtatggtagcgctgaagatttgcgtaatgccatcaaggccctgcacgctgctggcattcaggtcattgctgactgggtgccggatcaaatctattcgctgccaggcgaagaagtcgttacggcgactcgcgtgaatgactatggcgaagaaaccgaaggcgcgtacattaacaatacgttgtatgtggcgaacagcaaaagcagcggcgaggactaccaggcacagtatggtggtgagttcctggattacttgcaagaaacctacccggaaatgttcgaagttgcgatgattagcacgggtgagccgattgatccgagcaccaagatcaagatttggaaagcagaatactttaatggtacgaacattctgggtaagggcgctggttacgtgctgagcgatgccgcgactggcacgtactttaccgtgactgagaatggcacgtttctgccgaagcagctgaccaccgactccgccattacgggtttctattacgacggtacgggtatgtcttactttagcacctcgggttatcgcgctaaagcgagcttcattgtttacaacggctactactactattttgatgataacggctacatggtcactggcacggtggaaatcaacggtaagacctactatttcctgccgaatggtattcagctgcgtgatgcgatttacgaagacgagaacggtaatcagtactatttcggtccgttgggcaaccagtatttcaacaactattacagctttgacgttgaagaggtggtggacggtgtaacgactacggtaacgaagtggcgtcattttgacgagaacggcgtgatggcgcgtggtttggtcgagattgatggtgtctaccagtattacgatgaaaacggctaccaggtcaaaggtgagctgatcaccgatgctgatggtaatttgcgttatttcaaagaagatagcggtgaaatggttgttagcgattttgtgaagatcggcgataacaactggtactactttgacgaaaacggtattgcagtcacgggtgcccaaaccattgccggccagaacttgtatttcgatgacaacggtgtgcaggcgaaaggtgcctttgtcacgaacgccgatggcacgcgcagctattatgacgcggacagcggtgagaagatcgtggcagatttcttcactacgggcgataatgactggtattatgcagatgaaaatggcaatctggtgactggtagccaaactatcaatggtcaaaacctgtactttgctgaggacggtttgcaggccaagggtgtgtttgttaccgatacggctggtaacattcactattatgatgcgaactctggcgagttggcggttaataccttcgttggtgatggcgacgactggtattactttgatgagaatggcatcgcagttaccggcgcacaagtcattaacggtcaacacctgtatttcgcagacaacggcatccaagtgaaaggtgaaatcgtcaccgacgcaaacggcaaccgctattactacgatgcagattccggcgaaatggcagttaacacctttgtggagattgacggtgtttggtactattttggtgccgatggtatcgcggtgacgggtgcacaagtaattgatggtcagaatttgtactttaacgcagacggtagccaagtcaagggtgacgttgtccgtatcaacggtttgcgttactactacgacgctaatagcggcgaacaggtgcgcaatcagtgggtcacgctgccggatggtactgttgttttctttaatgcgcgtggctatacttggggctaa

SEQ ID NO: 46 - protein, 1355 aa, Streptococcus gallolyticus ATCC BAA-2069
MIDGKYYYIDEDGNVKKNFAITVDGQLLYFDAETGALTSTSTYSFSEGLTNLVDNFSINNQSYDSTEESFELIDGYLTVNTWYRPTKILENGETWVDSTETDFRPLLMAWWPDVDTQIDYLNYMSDYFDLGTTYSADDSQASLNLAAEAVQVKIEQEITRQENTAWLREIISSFVTTQDKWNINTENEGTDHLQGGALLYVNSDLTPWANSDYRLLNRTPTYQTGETNYFKADRTGGYEFLLANDVDNSNPVVQAEQLNQLYYLMNWGSIVFGDDDANFDGVRVDAVDNVNADLLQIYTNLFEAAYGVNESEAQALAHISILEAWSYNDPDYNHDTNGAALAIDNGLRLSFLYSLTRPTDERSGLEPLITSEIGLTDRSEDSAYGDTMPSYVFVRAHDSEVQTIIASIIAEQINPETDGYTFTLDELNQAFEIYNADMNSVDKEYTHYNIPAAYSLLLTNMESVPRVYYGDLYTDNGQYMATKSPYYDQITTLLQARIRYAAGGQSMAVTYYTPASSMSTDNADSVLNETGVLTSVRYGYGIMTADQEATDDSVLTSGIVTIISNNPNLQLDDSEVIAVQVGVAHAGQYYRPLLYPTADGLQSYLNDSDTDITKLVDDNGYIYFTADEIKGYETVDMNGYLSVWVPVGADENQDIRVSADTSAYTEGELIYQATAALDSQVIYEGFSNFQDFVTSNSEYTNKLIAENVDLFTSWGITSFEMAPQYVSTDDGTFLDSIIQNGYAFDDRYDLAMSQNNKYGSAEDLRNAIKALHAAGIQVIADWVPDQIYSLPGEEVVTATRVNDYGEETEGAYINNTLYVANSKSSGEDYQAQYGGEFLDYLQETYPEMFEVAMISTGEPIDPSTKIKIWKAEYFNGTNILGKGAGYVLSDAATGTYFTVTENGTFLPKQLTTDSAITGFYYDGTGMSYFSTSGYRAKASFIVYNGYYYYFDDNGYMVTGTVEINGKTYYFLPNGIQLRDAIYEDENGNQYYFGPLGNQYFNNYYSFDVEEVVDGVTTTVTKWRHFDENGVMARGLVEIDGVYQYYDENGYQVKGELITDADGNLRYFKEDSGEMVVSDFVKIGDNNWYYFDENGIAVTGAQTIAGQNLYFDDNGVQAKGAFVTNADGTRSYYDADSGEKIVADFFTTGDNDWYYADENGNLVTGSQTINGQNLYFAEDGLQAKGVFVTDTAGNIHYYDANSGELAVNTFVGDGDDWYYFDENGIAVTGAQVINGQHLYFADNGIQVKGEIVTDANGNRYYYDADSGEMAVNTFVEIDGVWYYFGADGIAVTGAQVIDGQNLYFNADGSQVKGDVVRINGLRYYYDANSGEQVRNQWVTLPDGTVVFFNARGYTWG

SEQ ID NO: 47 - DNA, 4047 bp, Streptococcus sanguinis SK405
atgatcgatggcaagaaatactatgttcaggacgacggtacggtaaagaagaatttcgcggttgaactgaacggcaaggtcctgtatttcgatgcagaaaccggtgccctggtcgacagcgcggagtaccagtttcaacagggtacgagctccctgaataacgagttcagccgcatgaatgcgttccatggcacgacggagaaagatattgaaaccgtcgatggctatctgaccgcagatacgtggtaccgcccgaaggccatcctgaaagatggcaaaacctggactcagagcaccgaaaccgatctgcgtccgctgctgatggcatggtggccggacaaacaaacgcaggtaagctacttgaactatatgaaccagcagggtctgggtgcgggtgcgtttgagaacaaagttgagcaggcaatcttgacgggcgcaagccagcaggtgcagcgcaagatcgaagaacgtattggcaaagacggcgataccaaatggctgcgtaccctgatgggtgcatttgtgaaaacccagccgaattggaatatcaagacggagagcgaaaccacgggtactaataaggatcatctgcaaggtggtgcgctgctgtacaccaactctgaaaagacgagccacgcgaacagcaaataccgtattctgaatcgtaccccgaccaatcagaccggtacgccgaagtatttcatcgacaaatcgaatggtggttacgagttcttgctggcaaatgattttgataatagcaacccagcagtccaagcggaacagctgaattggctgcactttatgatgaatttcggcagcattgttgcaaatgacccgaccgcaaacttcgatggcgtgcgtgtggatgcggtggacaatgttaatgccgatttgctgcaaattgccagcgactatttcaaatctcgttacaaagtgggcgagagcgaagaacaagcgattaaacatctgagcatcctggaagcctggagcgacaacgatccggactataacaaagacaccaaaggcgcccaactgccgatcgacaataagctgcgtctgagcctgttgtacagctttatgcgtaagctgagcattcgcagcggtgtcgaaccgacgattaccaacagcctgaacgaccgttctgcggagaagaagaacggtgagcgcatggcaaactatatctttgttcgtgcgcatgattccgaagtgcagacggtcattgccgacattattcgcgagaatatcaatccgaacacggatggtctgacctttaccatggacgagctgaaacaggcgttcaagatctacaatgaagatatgcgcaaggcggataagaagtatacccaattcaatattccgaccgctcacgcgttgatgttgagcaacaaggattccattacgcgtgtgtactacggtgacctgtatacggatgatggtcagtatatggaaaagaaaagcccttattacgacgcgatcgacgcgctgctgcgcgcacgcattaagtacgttgcgggtggccaggacatgaaagttacctacatgggtgtgccgcgtgaaaccgacaaatggagctacaacggcatcctgaccagcgtccgctacggcaccggcgcaaatgaggctacggacgagggtactgccgagactcgcacccagggtatggccgtcatcgcaagcaacaatccgaatttgaaactgaacgagtgggataagttgcaggtcaacatgggtgcggcacacaagaaccaatactatcgtccggtgctgctgaccaccaaggacggtattagccgttacctgaccgacgaagaagttccgcaaagcctgtggaagaaaaccgatgcaaacggcatcttgacgttcgacatgaacgatatcgcaggttacagcaatgtccaagtatctggctacttggctgtgtgggtgccggttggtgccaaagcggatcaagacgcgcgtgttactgcgtcgaagaagaaaaacgccagcggtcaggtgtatgagtccagcgctgcactggacagccaactgatttatgaaggcttctctaacttccaagacttcgcgacccgcgacgatcaatacaccaacaaagttattgccaaaaatgttaatctgtttaaagagtggggtgtgaccagctttgagctgccacctcagtatgtttccagccaggatggcacgtttttggatagcatcatccagaatggctacgcatttgaagatcgttatgacatggcgatgagcaaaaacaataagtacggtagcctggacgacctgctgaacgcgctgcgtgccttgcacagcgtcaacatccaagcgatcgcggactgggtcccggatcagatttacaacctgccgggcaaagaagtggttacggctacgcgtgtcaacaattatggtacctatcgtgagggtgcggaaatcaaagaaaatctgtacgtggcaaacacgaaaaccaacggcaccgactatcaaggcaaatacggtggtgcgttcctggacgaactgaaagcgaaatatcctgagatcttcgaacgtgttcaaatttccaatggtcaaaagatgaccaccgatgagaagattacgaaatggagcgcgaaacacttcaatggtaccaacattctgggccgtggtgcatactacgtgctgaaagattgggccagcaatgagtatctgaacaataagaatggtgagatggtgttgccgaagcaactggttaacaaaaacgcgtacaccggctttgttaaggacaccaccggttttaagtactatagcacctcgggctatcaagcgcgtaatagcttcatccaagatgagaacggtaattggtactactttgacaaacgtggttacctggcgactggtgcacacgaaatcgacggcaagcaggtctatttcctgaaaaacggcattcaactgcgcgactctctgcgtgaggacgagaacggcaatcagtactattacgacaagaccggtgcgcaggtgctgaaccgctactacaccaccgacggccagaactggcgttacttcgacgccaaaggtgttatggcgcgtggcctggttaccatgggtggtaaccaacaattcttcgaccagaacggttatcaggtgaaaggcaagatcgcgcgtgccaaggatggtaaactgcgctacttcgacaaagacagcggtaacgcagcggcgaatcgctttgcacagggcgataatccgagcgattggtattactttggtgccgatggcgtcgctgttaccggtttgcaaaaactgggtcaacaaactctgtactttgatcaagaaggtaaacaagtgaagggcaagattgtcacgctggctgataagtccatccgttacttcgatgcgaacagcggcgagatggctgtcggtaagtttgctgagggtagcaagaacgaatggtactatttcgatcagacgggcaaagcggttacgggtctgcaaaagattggccagcagaccctgtattttgaccaagatggtaagcaggtaaagggtaaagtggtaaccctggcagataagtcgattcgctactttgatgcaaactccggcgaaatggcggtgggtaagttcgccgagggtgctaagaatgagtggtactactttgaccaggcgggcaaggcggtgaccggcttgcagaaaattggtcagcaaacgctgtattttgatcaggacggcaaacaagtcaaaggccaactggtgacgctggcggacaagagcattcgttatttcgacgcaaacagcggtgagatggcctctaacaagttcgttgagggtgccaaaaacgaatggtactatttcgaccaagccggtaaagcagtgaccggtctgcaacaaatcggtcagcagaccttgtacttcgaccaaaacggtaaacaggtcaaaggtaaaatcgtgtatgttaacggtgccaatcgttactttgacgccaattcgggtgaaatggcgcgcaataagtggatccaactggaagatggtagctggatgtacttcgatcgtaacggtcgtggtcgtcgtttcggctggaattaa

SEQ ID NO: 48 - protein, 1348 aa, Streptococcus sanguinis SK405
MIDGKKYYVQDDGTVKKNFAVELNGKVLYFDAETGALVDSAEYQFQQGTSSLNNEFSRMNAFHGTTEKDIETVDGYLTADTWYRPKAILKDGKTWTQSTETDLRPLLMAWWPDKQTQVSYLNYMNQQGLGAGAFENKVEQAILTGASQQVQRKIEERIGKDGDTKWLRTLMGAFVKTQPNWNIKTESETTGTNKDHLQGGALLYTNSEKTSHANSKYRILNRTPTNQTGTPKYFIDKSNGGYEFLLANDFDNSNPAVQAEQLNWLHFMMNFGSIVANDPTANFDGVRVDAVDNVNADLLQIASDYFKSRYKVGESEEQAIKHLSILEAWSDNDPDYNKDTKGAQLPIDNKLRLSLLYSFMRKLSIRSGVEPTITNSLNDRSAEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYYDAIDALLRARIKYVAGGQDMKVTYMGVPRETDKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARVTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLDDLLNALRALHSVNIQAIADWVPDQIYNLPGKEVVTATRVNNYGTYREGAEIKENLYVANTKTNGTDYQGKYGGAFLDELKAKYPEIFERVQISNGQKMTTDEKITKWSAKHFNGTNILGRGAYYVLKDWASNEYLNNKNGEMVLPKQLVNKNAYTGFVKDTTGFKYYSTSGYQARNSFIQDENGNWYYFDKRGYLATGAHEIDGKQVYFLKNGIQLRDSLREDENGNQYYYDKTGAQVLNRYYTTDGQNWRYFDAKGVMARGLVTMGGNQQFFDQNGYQVKGKIARAKDGKLRYFDKDSGNAAANRFAQGDNPSDWYYFGADGVAVTGLQKLGQQTLYFDQEGKQVKGKIVTLADKSIRYFDANSGEMAVGKFAEGSKNEWYYFDQTGKAVTGLQKIGQQTLYFDQDGKQVKGKVVTLADKSIRYFDANSGEMAVGKFAEGAKNEWYYFDQAGKAVTGLQKIGQQTLYFDQDGKQVKGQLVTLADKSIRYFDANSGEMASNKFVEGAKNEWYYFDQAGKAVTGLQQIGQQTLYFDQNGKQVKGKIVYVNGANRYFDANSGEMARNKWIQLEDGSWMYFDRNGRGRRFGWN

SEQ ID NO: 49 - DNA, 4284 bp, Streptococcus salivarius
atgaaggatggcaaatactactacttgttggaagatggctcgcacaaaaagaatttcgcaatcaccgtcaatggtcaagtgctgtattttgacgagaacggtgcgctgagcagcaccagcacgtacagcttcacgcaggaaaccaccaatctggttacggactttacgaagaataatgcggcgtatgactccacgaaagcgtctttcgaattggtggacggctatctgaccgcagacagctggtatcgcccgaaagagattctggaagccggcaccacctggaaggcgagcaccgaaaaggacttccgtccgctgctgatgtcctggtggccggataaggacacgcaagttgcttatctgaattacatgacgaaagcactgtcgaacggcgaagaaaccaaggatgtctttacgatcgaaaacagccaagcgagcctgaatgcggcagcgcaaatcctgcaacgtaagattgaggtcaagattgcggccaacaagagcaccgactggctgcgccaaagcatcgaggcgtttgtcaaagaccaagataagtggaatatcaatagcgaaagccctggcaaagagcatttccagaagggtgcgctgctgtttgttaatagcgacagcaccaagtgggcgaactccgattatcgtaaactgaatcagaccgcgacgtcttacatcaagaatcataagatcgtgaacggtagcgatggtggttacgagttcttgctgagcaacgacatcgacaacagcaacccggtggtccaggcagagatgctgaatcaactgtactactttatgaactggggtcagattgtgttcggcgataaagataaagacgcacatttcgatggcatccgtgtggacgcggtggacaatgttagcgttgacatgctgcaactggtcagcagctacatgaaggcggcatacaaggtcaatgaatctgaagcccgtgcgctggcgaatatcagcattttggaagcgtggagccataatgacccgtattatgtgaacgagcacaatacggcagcactgagcatggataacggtctgcgtctgtctattgtgcatggtctgacgcgtccggtgactaacaaaggcacgggtgctcgtaacgccagcatgaaggacctgatcaacggcggttactttggcttgagcaaccgtgcggaagttactagctacgaccagctgggctttgccacttacctgtttgtgcgtgcgcatgacagcgaggttcagacggttatcgctgatattatttctaaaaagattgacccgaccaccgacggttttacctttaccctggaccagctgaagcaggcttttgatatttataacgcggacatgttgaaggttgataaagagtatacgcatagcaacatcccggctgcgtatgcgctgatgctgcaaacgatgggtgcagcgacccgcgtgtattacggcgatctgtacactgataacggccaatacatggcgaaaaagagcccgtattttgatcagattaccacgctgttgaaggcccgtccgaagtacgtggcgggtggccagacgagctacatccacaacctggcaggcgatggtgtcagctcggccaaagataacaaagaggttctggttagcgtgcgctacggtcaggatctgatgagcaaaacggatactgagggcggtaaatacggtcgtaacagcggtatgctgactctgatcgcgaacaacccggacctgaagctggccgatggtgagactatcacggttaacatgggtgctgcccacaaaaatcaggcgtatcgtccgttgctgctgggcacggaaaagggtattgtcagcagcctgaacgatagcgacaccaaaatcgtgaagtatacggacgcccaaggtaacctggttttcaccgccgacgagatcaagggcttcaaaaccgtggacatgtctggctacctgtctgtttgggttccggttggtgccacggatgaccagaacgtcctggcgaaaccgagcaccaaagcatacaaagaaggtgataaggtttacagcagcagcgcggctctggaagctcaggttatctatgaaggttttagcaatttccaggatttcgtgaaagaagatagccagtataccaataagctgattgcggctaatgcggacctgtttaagagctggggtatcacgagctttgagatcgcaccgcaatatgtgagcagcaaagatggtacttttctggacagcatcattgaaaatggttacgcgttcaccgatcgttatgacttcgcgatgagcaagaacaataagtatggtagcaaagaggatctgcgcgacgcgctgaaggcactgcacaaacaaggcatccaagtcatcgcggattgggtgccggatcagctgtataccctgccgggcaaagaggtggttacggcaacccgtaccgatacgcacggtaaagtgctggatgacacgagcctggtgaataaactgtatgtgaccaatacgaagtctagcggtaacgatttccaggcacagtatggtggtgcgttcctggataaactgcaaaagctgtacccagagattttcaaagaagttatggaagcgtccggcaagaccatcgacccaagcgtcaagattaaacaatgggaagctaaatactttaatggcacgaatattcaaaagcgtggttccgattatgttctgagcgatggcaaactgtactttacggttaacgataagggcaccttcctgcctgctgccctgacgggtgacaccaaggctaaaacgggttttgcctacgatggtacgggtgtcacgtattacactaccagcggtactcaagctaagagccagtttgtgacgtataatggtaagcaatactacttcaacgacaagggttacttggttaccggcgagcagacgattgatggctccaactatttcttcctgccgaatggtgttatgtttaccgatggtgtgcgtaaaaacgcgaagggtcagagcctggtttatggcaagtctggtaagctgaccacgcaaacgggctggaaagaagtgaccgttaaagatgatagcggcaaagaagaaaagttttaccagtatttcttcaagggtggcatcatggcgaccggcctgacggaagttgaaggtaaagagaagtatttctatgacaatggctaccaggctaaaggcgtctttgtcccgaccaaagacggccacctgatgttcttttgcggcgacagcggtgagcgtaaatacagcggtttctttgaacaagacggtaactggtactatgcgaatgacaagggctacgtcgcgaccggctttaccaaggtgggtaaacaaaatctgtatttcaatgagaaaggcgtccaggtcaaaaaccgctttttccaagtgggtgacgccacctattacgcgaataacgagggcgacgtgctgcgtggtgcgcaaaccatcaatggtgatgagctgtacttcgacgaaagcggcaaacaagttaagggtgagttcgtgaataacccagacggcacgacctcttactatgatgcgatcacgggcgttaagctggtcgatacctcgctggttgttgatggtcagacgttcaacgtggatgcgaagggtgtcgtaaccaaggcgcacacgccgggtttctacaccacgggcgacaacaactggttctacgcagatagctatggtcgtaatgttaccggtgcgcaagtaatcaacggccaacacctgtatttcgatgcaaatggtcgtcaagtgaaaggcggctttgtcacgaacacggacggtagccgtagcttttaccactggaataccggcgacaaactggtgtccacgttctttgcgacgggtcacgatcgctggtactacgctgatgatcgtggcaacgtcgtcacgggtgcacaggtcatcaacggtcagaagctgttctttgacaccgatggtaaacaagtcaaaggtgctttcgcgaccaacgcgaatggttcccgtagctattatcattggaatacgggcaacaagctggtgagcaccttcttcacctcgggtgacaataactggtattacgcggacgccaaaggtgaggttgtggtcggtgaacagacgattaatggccagcacctgtactttgaccagactggcaagcaagtgaagggcgcgactgcaacgaacccggacggctcgatcagctattatgatgtgcacacgggtgaaaaggctatcaatcgttgggtgaagattccgagcggtcaatgggtgtacttcaatgcgcagggcaaaggttacgtcagcaactaa

SEQ ID NO: 50 - protein, 1427 aa, Streptococcus salivarius
MKDGKYYYLLEDGSHKKNFAITVNGQVLYFDENGALSSTSTYSFTQETTNLVTDFTKNNAAYDSTKASFELVDGYLTADSWYRPKEILEAGTTWKASTEKDFRPLLMSWWPDKDTQVAYLNYMTKALSNGEETKDVFTIENSQASLNAAAQILQRKIEVKIAANKSTDWLRQSIEAFVKDQDKWNINSESPGKEHFQKGALLFVNSDSTKWANSDYRKLNQTATSYIKNHKIVNGSDGGYEFLLSNDIDNSNPVVQAEMLNQLYYFMNWGQIVFGDKDKDAHFDGIRVDAVDNVSVDMLQLVSSYMKAAYKVNESEARALANISILEAWSHNDPYYVNEHNTAALSMDNGLRLSIVHGLTRPVTNKGTGARNASMKDLINGGYFGLSNRAEVTSYDQLGFATYLFVRAHDSEVQTVIADIISKKIDPTTDGFTFTLDQLKQAFDIYNADMLKVDKEYTHSNIPAAYALMLQTMGAATRVYYGDLYTDNGQYMAKKSPYFDQITTLLKARPKYVAGGQTSYIHNLAGDGVSSAKDNKEVLVSVRYGQDLMSKTDTEGGKYGRNSGMLTLIANNPDLKLADGETITVNMGAAHKNQAYRPLLLGTEKGIVSSLNDSDTKIVKYTDAQGNLVFTADEIKGFKTVDMSGYLSVWVPVGATDDQNVLAKPSTKAYKEGDKVYSSSAALEAQVIYEGFSNFQDFVKEDSQYTNKLIAANADLFKSWGITSFEIAPQYVSSKDGTFLDSIIENGYAFTDRYDFAMSKNNKYGSKEDLRDALKALHKQGIQVIADWVPDQLYTLPGKEVVTATRTDTHGKVLDDTSLVNKLYVTNTKSSGNDFQAQYGGAFLDKLQKLYPEIFKEVMEASGKTIDPSVKIKQWEAKYFNGTNIQKRGSDYVLSDGKLYFTVNDKGTFLPAALTGDTKAKTGFAYDGTGVTYYTTSGTQAKSQFVTYNGKQYYFNDKGYLVTGEQTIDGSNYFFLPNGVMFTDGVRKNAKGQSLVYGKSGKLTTQTGWKEVTVKDDSGKEEKFYQYFFKGGIMATGLTEVEGKEKYFYDNGYQAKGVFVPTKDGHLMFFCGDSGERKYSGFFEQDGNWYYANDKGYVATGFTKVGKQNLYFNEKGVQVKNRFFQVGDATYYANNEGDVLRGAQTINGDELYFDESGKQVKGEFVNNPDGTTSYYDAITGVKLVDTSLVVDGQTFNVDAKGVVTKAHTPGFYTTGDNNWFYADSYGRNVTGAQVINGQHLYFDANGRQVKGGFVTNTDGSRSFYHWNTGDKLVSTFFATGHDRWYYADDRGNVVTGAQVINGQKLFFDTDGKQVKGAFATNANGSRSYYHWNTGNKLVSTFFTSGDNNWYYADAKGEVVVGEQTINGQHLYFDQTGKQVKGATATNPDGSISYYDVHTGEKAINRWVKIPSGQWVYFNAQGKGYVSN

SEQ ID NO: 51 - DNA, 4182 bp, Unknown
  unknown Streptococcus sp. C150
atgatcaatggcaaacagtactatgtaaattcggacggtagcgtgcgtaagaatttcgtttttgaacaggatggtaagagctactactttgacgcggaaactggcgcgctggccactaaaagccaagatgaatttagcacggagccgattaaagcagcagtggacttctctagcggcaaccagctgtacaaaaatgacaacaaatcgctggatcagctggatacgtttatcaccgctgacgcatggtaccgccctaagtctattctgaaggatggcaaaacctggaccgcgtctaccgaagctgataagcgtccgttgctgatggtgtggtggccggacaagtccacccaagttaactacctgaactacatgcagaaccagggtttgggtgcgggtagcttcagcaccaatagcagccaagaatccctgaatctggctgcgaaagcagttcagaccaagatcgaagaacgcatcgcacgtgagggtaacaccaattggctgcgtaccagcattgaccaattcattaagacgcagccaggctggaacagcagcactgagaatagcagctatgatcacttgcagggtggtcaactgctgttcaataacagcaaaggtgatacgggtaaccgcaccagctatgcgaatagcgactatcgtctgctgaaccgtaccccaactaatcaaagcggcacccgtaagtactttaaggataattccatcggtggtctggaatttctgctggcaaacgacatcgacaacagcaaccctgccgttcaggcggagcagctgaactggctgcacttcatgatgaacattggttctatcatggcgaatgacccgacggcgaactttgatggtttgcgtgtggacgcgttggataacgtggatgcggacctgttgcagatcgcgagcgattacttcaaggcagtctacggtgttgataaatccgaggcgaatgcgatcaagcacctgagctatctggaggcgtggagcgccaatgacccgtattacaacaaggataccaaaggcgcgcaactgccgattgacaacgcgctgcgcaacgcactgaccaacctgttgatgcgtgacaagaatacgcgcatgcagctgggtgacatgacggcgtttatgaatagctctctgaacccacgtggtgcgaatgacaaaaacggcgagcgtatggcgaattacattttcacccgcgcacacgataccgaggcgcagaccatcattcagcgtattatccgcgatcgtatcaatccgaacctgtttggctacaatttcacccgcgatgaaatcaaaaaggcgtttgagatctacaacgcggacattaacacggcgcataagacgtacgcgagctacaatctgccgtccgtctacgcactgatgctgacgaataaggacagcgtgacccgtgtgtattacggtgacctgtatcgtgaggacggtcactacatggccaagaaaacgccttatttcgatgcaatcgataccctgctgcgtgcgcgcatcaaatacgtggcgggtggtcaagacatggaggtgaagaaagttggtaatgacggcttgctgacgagcgtccgctatggcaagggtgcgaacaatagcaccgactggggcacgactgaaacccgtacccaaggtatgggcgttatcctgacgaacaactatgatttccgcctgggcagcaacgaaaccgtcacgatgaacatgggccgtgcgcatcgcaatcagctgtatcgtccgctgctgctgacgaccaaggatggtctggccacgtacctgaatgatagcgacgtgccttcgaatttgctgaaacgcacggactggaatggtaacttgacctttaatgccaacgatgtgtttggtgtagagaacgtccaggtcagcggttacctgggtgtttgggtaccggttggtgctaaagctaaccaggatgcgcgtacccaaccgagcaaccgtgcgaacagcgatggtcaggtctataagtcgtctgcggcattggacagccaggtcatgtatgaggcgtttagcaattttcaggcatttgcggacgatcaaccggaactgtacatgaaccgcgttctggcgaagaacaccgatctgctgaaagcgtggggcgttactagcgttggcttgccgccacaatacgttagcagcaaagacggcaccttcctggatagcactattgataacggctatgcgttcgatgatcgttacgacatggcgctgagccagaacaacaaatacggttctctggaggacttgctgaacgttctgcgcgctctgcacaaagacggtattcaggcgattgcggactgggtcccggatcaaatctacaatttgccgggtaaagaggttgttaatgcgacgcgtgttaacggttacggttaccatcagcagggctaccagattgttgaccaggcgtacgttgcaaacacccgtacggatggtaccgattatcagggtcgttacggtggtgcttttctggacgaactgaaggcgaagtacccgagcattttcaatcgtgtccagattagcaacggtaaacagctgccaaccaatgagaaaatcacgaaatggtccgcgaaatacttcaatggcacgaacatcctgggccgtggtattaactatgtgctgcgcgacgacaagaccaatcagtatttcaacaccagcgcaaacggccaactgctgccgacgccactgcgcgacaccggtgccatcaccagcacgcaagttttccagcgtcgtggccaagacgtctattttctgcgtgataaccaggttatcaaaaacgagtttgtgcaagatggtaacggtaattggtactacttcggtgccgacggtaaaatgacgaagggtgcacaaaacatcaatagcaaggattactatttcttcgataatggcgtccagctgcgtaatgcgctgcgtcgcgcgtccaatggttacacctactattatggcctggacggtgccatgatcaagaacgctttcgtcgattttgatgataagcaccaacaggtgcgtgcgtttactacgcagggcacgatggtggtcggtaatttgcactggagcggtcaccacttctattttgaccgcgaaacgggtatccaagccaaagaccgcattgtgcgtaccgatgatggcaagctgcactattatgtcgcacaaaccggcgatatgggccgcaatgtgtttgcgaccgacagccgcacgggcaagcgctattactttgatgcggacggcaacaccgttacgggctcccgtgtcatcgacggcaagacctactacttcaaccaggacggttcggtcggtaccgcgtacagcaatcgtgcggatagcattatctttgagaatggcaaggctcgctatatcactccggctggcgagattggccgttccatttttgtctacaacccggcgaccaaagcgtggaattacttcgacaaggaaggtaaccgtgtcaccggtcgtcagtatattgacggcaatctgtactactttaaagaggacggctcccaagtgaaaggtgcgattgttgaagagaacggtatcaagtactactacgaaccgggcagcggtatcctggcgagcggtcgttatctgcaagtcggtgacgaccaatggatctacttcaaacacgacggtagcctggcgatcggtcaggttcgtgcagacggtggttacttgaaatactttgataagaatggcatccaggtcaagggccaaaccattgtggaggatggtcatacctattactacgatgccgactccggtgctctggtgacctctagcttcgcggagattgctccgaaccagtgggcctacttcaataccgagggccaagccctgaagggcaaatggaccatcaatggtaaagagtactattttgatcagaacggcattcagtataaaggcaaggcagttaaggtcggcagccgttacaaatactatgacgagaatgacggtcaaccggtcactaaccgttttgcccagattgagccgaacgtctgggcgtactttggtgccgatggctacgcagttactggcgaacaggtgattaatggccagcacctgtacttcgatcagtcgggtcgtcaggttaaaggtgcgtacgtcaccgtgaatggtcaacgtcgttactacgacgcaaacacgggtgaatacattccgggtcgttaa

SEQ ID NO: 52 - protein, 1393 aa, Unknown
  unknown Streptococcus sp. C150
MINGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQGTMVVGNLHWSGHHFYFDRETGIQAKDRIVRTDDGKLHYYVAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPGSGILASGRYLQVGDDQWIYFKHDGSLAIGQVRADGGYLKYFDKNGIQVKGQTIVEDGHTYYYDADSGALVTSSFAEIAPNQWAYFNTEGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 53 - DNA, 3789 bp, Leuconostoc citreum KM20
atgattaacggccacaattactatttcgacagcttgggtcaactgaagaaaggtttcacgggcgtgatcgacggtcaggtccgttacttcgaccaggagtccggtcaggaagttagcaccaccgacagccaaatcaaagagggcttgacgagccaaacgaccgactacaccgcccataacgcggtccacagcacggactccgcagattttgacaacttcaatggttacctgaccgcgagcagctggtatcgtcctaaggacgttctgcgtaacggccaacattgggaagccaccaccgcgaatgacttccgtcctatcgtcagcgtgtggtggccgagcaagcaaacgcaggtcaactacctgaactatatgagccagatgggtttgatcgataaccgtcaaatgttctcgttgaaagataaccaagcgatgctgaacatcgcgtgcacgaccgtgcaacaagcaatcgaaactaaaatcggtgtggcgaatagcaccgcgtggctgaaaaccgcgatcgatgactttatccgtacccagccgcagtggaacatgagcagcgaagatccgaagaatgaccatctgcaaaatggcgccctgacgtttgttaacagcccgctgaccccggatacgaatagcaatttccgcctgctgaatcgtaccccgaccaatcaaaccggtgttccgaaatacaccatcgaccaaagcaaaggtggttttgaactgctgctggcgaatgacgtggataattcgaacccggttgtgcaggccgagcagttgaactggctgcactacctgatgaactttggtagcattactgcgaatgacagcgcagcaaacttcgacggtattcgcgttgacgcagtggataacgtggatgcggacctgctgcaaattgcggcagattacttcaaagcagcatacggtgtggacaagaacgacgcaacggcaaatcagcatctgtcgatcctggaagattggagccacaacgacccggagtacgttaaagacttcggcaataaccaactgaccatggacgattacatgcacacgcagctgatctggagcctgacgaaagacatgcgtatgcgtggtacgatgcagcgctttatggactactatctggttaaccgcaatcacgacagcaccgagaatactgccattccgaattacagctttgtccgtgcccatgacagcgaagttcaaacggttattgcgcagatcatttctgagctgcatccagacgtgaagaatagcctggcgccgaccgcggatcaactggctgaggcgttcaaaatctacaacaacgacgagaagcaagctgataagaagtatacccaatacaatatgccaagcgcgtacgcaatgctgttgaccaataaagataccgttccgcgtgtttactacggtgacctgtataccgatgacggtcagtatatggctaacaaatccccgtattttgacgctatcaacggtctgctgaagagccgtatcaaatatgtggcaggcggtcaaagcatggcggtggatcagaatgatatcctgacgaatgtgcgctatggcaaaggtgccatgagcgtgacggatagcggcaacgcggatacgcgtacccagggcatcggcgttattgttagcaacaaagaaaacctggctctgaaatccggcgacaccgttaccctgcacatgggcgcagcgcacaagaaccaggcgtttcgcctgctgttgggtacgacggcggacaacctgagctactacgacaatgacaatgcgccggtgaagtacaccaatgatcaaggtgatctgattttcgataataccgagatttatggtgttcgcaatccgcaagtctctggttttctggcggtgtgggtcccggttggtgccgatagccatcaagatgctcgcactttgagcgacgatacggcacaccacgacggcaagaccttccactcgaacgcagcactggatagccaggtgatttacgaaggttttagcaacttccaagcatttgcaacgaatacggaagattacactaacgctgtgatcgccaaaaacggccagctgttcaaggattggggcatcacctcgttccagctggctccgcagtatcgcagctccaccgatacgagcttcctggatagcattattcagaacggctatgccttcacggaccgttatgacctgggctatggcaccccgacgaagtatggcaccgtggaccagctgcgcgatgcaatcaaggctctgcacgccaatggcatccaagcaattgccgactgggttccggaccagatctacaacctgccgggtcaggagctggccacggtgacccgtacgaactcctatggtgataaagacaccaatagcgatattgatcagagcttgtacgtgatccaatcgcgcggtggcggtaagtatcaagcccaatacggtggtgcattcctgagcgacattcaaaagaagtatccggctctgttcgagactaaacagatcagcacgggtctgccgatggacccgagccaaaagattaccgagtggagcggcaagtacttcaacggtagcaatattcaaggtaagggcgctggttacgtcctgaaggacagcggcaccgaccagtactataaagtgacgagcaacaataacaaccgtgatttcctgccgaaacagctgacggatgatctgtctgaaaccggttttgtgcgtgacaatattggcatggtctattacaccctgtctggctacctggcacgcaataccttcatccaggacgacaacggtaactattactactttgatagcaccggtcacctggttacgggtttccagaacattaacaaccaccactactttttcttgccgaacggcattgaactggttcagagctttctgcaaaacgctgatggtagcacgatctacttcgatcaaaagggtcgtcaagttttcaaccagtatatcactgatcagactggtaccgcgtactacttccagaacgacggcaccatggtcacttctggctttactgagatcgatggccacaagcagtatttctataagaatggcactcaggttaagggtcagtttgtgagcgacaccgatggtcacgtcttttacctggaagcgggtaatggtaatgtcgccacgcaacgtttcgcacagaacagccagggtcaatggttctacttgggtaatgatggcattgcgttgacgggtttgcagacgatcaacggtgttcagaactacttttatgcggacggtcatcaaagcaagggtgacttcatcaccatccagaatcatgtcctgtacaccaacccgctgacgggtgccatcacgaccggcatgcaacagatcggcgacaaaatcttcgtgtttgataatacgggtaatatgctgacgaaccagtattatcagacgctggatggtcagtggctgcacctgagcacccagggtccagcagatacgggtctggtcaatatcaatggtaatctgaagtattttcaggcaaatggtcgtcaggtgaaaggccaattcgtcaccgacccgattaccaacgtcagctactacatgaacgcgacggacggtagcgcagtgttcaatgactatttcacctatcagggccaatggtatttgacggactccaactatcagttggtcaaaggcttcaaagtggtgaacaacaaactgcaacatttcgatgaaatcaccggtgtgcaaaccaagagcgctcacattattgttaacaatcgtacctacatttttgacgaccagggctattttgtcagcgtggcataa

SEQ ID NO: 54 - protein, 1262 aa, Leuconostoc citreum KM20
MINGHNYYFDSLGQLKKGFTGVIDGQVRYFDQESGQEVSTTDSQIKEGLTSQTTDYTAHNAVHSTDSADFDNFNGYLTASSWYRPKDVLRNGQHWEATTANDFRPIVSVWWPSKQTQVNYLNYMSQMGLIDNRQMFSLKDNQAMLNIACTTVQQAIETKIGVANSTAWLKTAIDDFIRTQPQWNMSSEDPKNDHLQNGALTFVNSPLTPDTNSNFRLLNRTPTNQTGVPKYTIDQSKGGFELLLANDVDNSNPVVQAEQLNWLHYLMNFGSITANDSAANFDGIRVDAVDNVDADLLQIAADYFKAAYGVDKNDATANQHLSILEDWSHNDPEYVKDFGNNQLTMDDYMHTQLIWSLTKDMRMRGTMQRFMDYYLVNRNHDSTENTAIPNYSFVRAHDSEVQTVIAQIISELHPDVKNSLAPTADQLAEAFKIYNNDEKQADKKYTQYNMPSAYAMLLTNKDTVPRVYYGDLYTDDGQYMANKSPYFDAINGLLKSRIKYVAGGQSMAVDQNDILTNVRYGKGAMSVTDSGNADTRTQGIGVIVSNKENLALKSGDTVTLHMGAAHKNQAFRLLLGTTADNLSYYDNDNAPVKYTNDQGDLIFDNTEIYGVRNPQVSGFLAVWVPVGADSHQDARTLSDDTAHHDGKTFHSNAALDSQVIYEGFSNFQAFATNTEDYTNAVIAKNGQLFKDWGITSFQLAPQYRSSTDTSFLDSIIQNGYAFTDRYDLGYGTPTKYGTVDQLRDAIKALHANGIQAIADWVPDQIYNLPGQELATVTRTNSYGDKDTNSDIDQSLYVIQSRGGGKYQAQYGGAFLSDIQKKYPALFETKQISTGLPMDPSQKITEWSGKYFNGSNIQGKGAGYVLKDSGTDQYYKVTSNNNNRDFLPKQLTDDLSETGFVRDNIGMVYYTLSGYLARNTFIQDDNGNYYYFDSTGHLVTGFQNINNHHYFFLPNGIELVQSFLQNADGSTIYFDQKGRQVFNQYITDQTGTAYYFQNDGTMVTSGFTEIDGHKQYFYKNGTQVKGQFVSDTDGHVFYLEAGNGNVATQRFAQNSQGQWFYLGNDGIALTGLQTINGVQNYFYADGHQSKGDFITIQNHVLYTNPLTGAITTGMQQIGDKIFVFDNTGNMLTNQYYQTLDGQWLHLSTQGPADTGLVNINGNLKYFQANGRQVKGQFVTDPITNVSYYMNATDGSAVFNDYFTYQGQWYLTDSNYQLVKGFKVVNNKLQHFDEITGVQTKSAHIIVNNRTYIFDDQGYFVSVA

SEQ ID NO: 55 - DNA, 4284 bp, Streptococcus salivarius SK126
atgaaagacggcaagtactattacctgttggaggacggtagccacaagaaaaactttgcgatcacggtcaacggccaagtgctgtatttcgatgagaacggtgcactgagcagcacgtctacctattcgtttacccaggagactaccaacctggttaccgatttcactaagaataatgctgcgtacgacagcaccaaggcttccttcgagctggttgatggctacctgactgcggacagctggtatcgtccgaaggaaatcctggaggctggcaccacctggaaagcgagcaccgagaaagactttcgtccgctgctgatgagctggtggccggataaagacacccaggttgcgtacctgaattacatgacgaaggcgctgagcaatggcgaggaaacgaaagacgtgtttacgatcgagaactcccaagcatctctgaacgcagccgctcagatcatccaacgcaagatcgaggtcaagattgcagcgaacaaaagcacggactggctgcgccagagcatcgaggcgttcgtgaaagatcaagacaagtggaatatcaattcggagagcccgggtaaagagcatttccaaaaaggtgctctgctgttcgttaacagcgacctgaccaaatgggcgaatagcgactatcgtaaactggaccaaacggcgaccagccgtctgccgaaagacaagattaagagcggcagcgatgcgggctacgagtttttgctgtcctctgacattgataacagcaacccgattgttcaggcggagatgctgaaccaactgtactatttcatgaactggggtcagattgtgtttggcgacaaagataaggatgcccatttcgacggtatccgcgtcgacgccgtagacaacgttagcattgatatgctgcaactggttagctcttatatgaaggcggcatacaaagttaatgaaagcgaagcgcgtgcactggcaaacatttccattctggaggcttggagccagaacgatccgtactacgttgatgaacacaacacggctgcgctgtctatggacaacggtctgcgcctgagcatcgttcacggtttgacccgtccggttactaacaagggtaccggtgcccgtaatgcaagcatgaaagacctgatcaacggtggctacttcggcttgtccaatcgtgcagaagttacgagctacgatcagctgggcttcgccacctacctgtttgtgcgtgcccatgactctgaagttcagaccgttatcgcggacattatctcgaagaaaatcgatccaaccacggacggtttcacgttcaccctggaccagttgaaacaagccttcgacatctacaacgccgatatgctgaaggttgataaggagtacacgcacagcaacatcccggctgcgtatgccctgatgctgcaaactatgggtgcggctacgcgcgtgtattatggtgatttgtatacggacaatggccagtacatggcgaaaaagagcccgtactttgatcagatcacgaccctgctgaaggcgcgtagcaagtacgttgcgggtggccagaccagctacatccataacctggcgggtgatggtgtcagcagcgcgaaggataacaaagaggtgttggtcagcgtccgctacggtcaggatttgatgagcaaaaccgacaccgagggtggtaagtatggtcgtaacagcggtatgctgaccctgatcgccaacaaccctgatctgaagctggcagacggtgaaaccatcaccgtcaacatgggcgcagcgcacaagaatcaagcatatcgtccgttgttgctgggcaccgaaaagggcattgtgagcagcctgaatgattccgacacgaaaattgttaagtataccgacgcgcaaggcaatctggtttttaccgctgatgagatcaaaggtttcaaaaccgtggatatgagcggttacctgtccgtgtgggtgccggttggcgcgaccgaggaccaaaacgtgctggccaagccgagcacgaaggtctacaaagagggtgataaagtttattcgagcagcgcggcactggaagcacaggtgatctacgagggttttagcaattttcaagacttcgtgaaggaagatagccagtataccaacaagctgattgcggccaatgcggacctgttcaaaagctggggtattacgagctttgaaatcgctccgcagtatgttagctccaaggatggcaccttcctggatagcatcattgagaatggctacgcgtttaccgatcgttacgacttcgcgatgtcgaaaaacaataagtacggctccaaagaggatctgcgtgacgcgttgaaagccctgcacaaacaaggcattcaagttattgcagattgggtcccggaccagctgtacaccctgccgggtaaggaagtggtcacggcgacccgcacggacacccacggtaaagtcctggatgacacctccctggtcaataaactgtacgttaccaataccaaatctagcggtaacgacttccaggcgcaatacggcggtgcattcctggacaaactgcaaaagttgtacccggagattttcaaggaagtgatggaggctagcggcaaaaccattgatccgtccgtcaaaatcaagcagtgggaggcaaagtatttcaacggtacgaacattcagaaacgcggtagcgactacgttctgagcgacggcaaactgtatttcacggtaaacgacaaaggtaccttcttgccggcagctctgaccggtgacacgaaggcaaagaccggtttcgcctatgacggtactggcgtcacttactatacgacctccggcacgcaggcaaagagccaatttgtcacctacaatggcaagcagtactatttcaatgacaaaggttatctggtcacgggtgaacaggcgattgacggtagcaactacttcttcctgccgaacggcgttatgtttacggacggtgtgatcaaaaatgctaaaggtcagtctctggtctacggcaaatctggtaagctgaccacgcaaaccggttggaaggaagttacggtgaaggatgatagcggcaaggaagagaaattctaccaatacttctttaagggtggcattatggcgacgggtctgaccgaggttgaaggtaaagagaaatacttttatgataatggttatcaggctaaaggtattttcatccctaccaaagacggccatctgatgtttttctgcggtgatagcggtgagcgtaaatacagcggtttcttcgaacaagacggtaactggtattacgcaaacgataaaggttacgtcgcgaccggttttaccaaagtgggtaagcagaacttgtactttaacgagaaaggtgtgcaggtcaagaaccgtttctttcaggttggtgatgctacttattacgcgaataacgagggtgatgtactgcgtggtgcacagacgatcaacggcgacgaactgtacttcgacgaaagcggcaagcaagtcaaaggtgaatttgtgaataacccggacggtaccacgagctattatgacgcaattaccggtgtgaaactggtggacaccagcttggtcgttaatggtcaaacgttcaacattgacgctaaaggcgttgtcaccaaggcgcacacgccgggtttctataccactggcgacaacaattggttttatgcagatagccacggtcgcaatgtcactggcgcacagatcattaacggccaacacctgtatttcgatgcgaatggccgtcaggtgaagggcggctttgttatgaacactgatggttctcgttcgttctatcattggaataccggtgataaactggtgagcacgttctttacgaccggccacgatcgttggtactacgccgacgacaaaggtaacgtggtgaccggcgcacaagtcatcaacggtcagaaattgttcttcgcgaccgacggtaaacaagttaagggcgatttcgcgaccaacgcaaatggttcccgttcttactatcacggtgccacgggtaataagctggtcagcaccttctttaccacgggcgataacaactggtactatgcagacgcgaagggcgaggttgtcgttggtgaacaaacgattaacggtcaaaatctgtattttgatcagaccggtaagcaagtgaaaggtgcgaccgcgaccaatccagatggcagcatttcttattacgatgttcacacgggcgagaaggtcatcaaccgctgggtcaaaattccgagcggtcaatgggtgtacttcaacgcgcagggtaagggttacgtcagcaattaa

SEQ ID NO: 56 - protein, 1427 aa, Streptococcus salivarius SK126
MKDGKYYYLLEDGSHKKNFAITVNGQVLYFDENGALSSTSTYSFTQETTNLVTDFTKNNAAYDSTKASFELVDGYLTADSWYRPKEILEAGTTWKASTEKDFRPLLMSWWPDKDTQVAYLNYMTKALSNGEETKDVFTIENSQASLNAAAQIIQRKIEVKIAANKSTDWLRQSIEAFVKDQDKWNINSESPGKEHFQKGALLFVNSDLTKWANSDYRKLDQTATSRLPKDKIKSGSDAGYEFLLSSDIDNSNPIVQAEMLNQLYYFMNWGQIVFGDKDKDAHFDGIRVDAVDNVSIDMLQLVSSYMKAAYKVNESEARALANISILEAWSQNDPYYVDEHNTAALSMDNGLRLSIVHGLTRPVTNKGTGARNASMKDLINGGYFGLSNRAEVTSYDQLGFATYLFVRAHDSEVQTVIADIISKKIDPTTDGFTFTLDQLKQAFDIYNADMLKVDKEYTHSNIPAAYALMLQTMGAATRVYYGDLYTDNGQYMAKKSPYFDQITTLLKARSKYVAGGQTSYIHNLAGDGVSSAKDNKEVLVSVRYGQDLMSKTDTEGGKYGRNSGMLTLIANNPDLKLADGETITVNMGAAHKNQAYRPLLLGTEKGIVSSLNDSDTKIVKYTDAQGNLVFTADEIKGFKTVDMSGYLSVWVPVGATEDQNVLAKPSTKVYKEGDKVYSSSAALEAQVIYEGFSNFQDFVKEDSQYTNKLIAANADLFKSWGITSFEIAPQYVSSKDGTFLDSIIENGYAFTDRYDFAMSKNNKYGSKEDLRDALKALHKQGIQVIADWVPDQLYTLPGKEVVTATRTDTHGKVLDDTSLVNKLYVTNTKSSGNDFQAQYGGAFLDKLQKLYPEIFKEVMEASGKTIDPSVKIKQWEAKYFNGTNIQKRGSDYVLSDGKLYFTVNDKGTFLPAALTGDTKAKTGFAYDGTGVTYYTTSGTQAKSQFVTYNGKQYYFNDKGYLVTGEQAIDGSNYFFLPNGVMFTDGVIKNAKGQSLVYGKSGKLTTQTGWKEVTVKDDSGKEEKFYQYFFKGGIMATGLTEVEGKEKYFYDNGYQAKGIFIPTKDGHLMFFCGDSGERKYSGFFEQDGNWYYANDKGYVATGFTKVGKQNLYFNEKGVQVKNRFFQVGDATYYANNEGDVLRGAQTINGDELYFDESGKQVKGEFVNNPDGTTSYYDAITGVKLVDTSLVVNGQTFNIDAKGVVTKAHTPGFYTTGDNNWFYADSHGRNVTGAQIINGQHLYFDANGRQVKGGFVMNTDGSRSFYHWNTGDKLVSTFFTTGHDRWYYADDKGNVVTGAQVINGQKLFFATDGKQVKGDFATNANGSRSYYHGATGNKLVSTFFTTGDNNWYYADAKGEVVVGEQTINGQNLYFDQTGKQVKGATATNPDGSISYYDVHTGEKVINRWVKIPSGQWVYFNAQGKGYVSN

SEQ ID NO: 57 - DNA, 5208 bp, Lactobacillus reuteri
atggatcagcaagtacaaagcagcaccacccaggagcagacgagcacggttaacgcggacacgactaaaaccgtcaatctggataccaacactgaccagccggctcagacgaccgataagaatcaggtcgcgaatgataccaccaccaaccaaagcaagacggacagcaccagcacgacggttaagaatccgacgtttattcctgttagcactttgtccagctccgataacgaaaagcagagccagaattacaataaaccagataacggtaattacggtaatgttgatgcggcctacttcaataacaatcagctgcacattagcggttggcacgcaaccaacgcgagccagggtacggatagccgccaagtaatcgtacgcgacattaccaccaagaccgagctgggtcgtactaatgtgaccaacaatgttctgcgtccggacgtgaaaaatgttcacaacgtctacaacgctgacaacagcggctttgatgtgaatatcaatattgatttcagcaagatgaaagactatcgtgacagcatcgagatcgtttctcgttatagcggcaacggcaagagcgttgactggtggtcgcagccgatcacgtttgacaaaaacaattatgcttatctggacactttcgaggtgaagaacggtgaactgcatgcaacgggctggaatgccaccaacaaggctatcaattacaatcaccacttcgttattctgtttgatcgtacgaatggcaaagaagtcacccgccaagaggtgcgtgatggtcaaagccgtccggatgtggcgaaggtatacccgcaagtcgttggcgcgaacaatagcggttttgacgttacgtttaacattggtgatttggactacacccatcagtaccagatcctgtctcgttacagcaacgcagacaacggtgaaggcgattatgtgacctattggtttgcgccgcagagcatcgctccggcgaatcaaagcaaccaaggttacctggacagcttcgatatttcgaaaaacggtgaggtgaccgtgacgggttggaatgcgacggatctgagcgagttgcaaacgaatcactacgtgatcctgtttgatcagacggcgggtcaacaggttgcatccgctaaggtcgacctgatcagccgtccagacgtcgcgaaggcgtaccctaccgttaaaacggcagaaacctccggtttcaaggtcacgtttaaggttagcaatctgcaaccgggccaccaatacagcgtcgttagccgctttagcgccgatgaaaacggtaatggcaacgacaaacgccacacggactactggtactctccggttaccctgaaccaaacggctagcaacattgacactatcaccatgacttccaacggtctgcacatcaccggctggatggcgagcgataatagcattaacgaagcgaccccgtacgcgattatcctgaacaacggtcgcgaggtgacgcgccagaaactgaccctgatcgcgcgtccggatgttgcggcagtgtatccgagcctgtacaatagcgcggttagcggcttcgacaccaccatcaagctgactaacgcgcaatatcaagcattgaacggccagctgcaagtgctgctgcgctttagcaaggcggtggacggtaacccgaatggtaccaataccgtcacggatcaatttagcaaaaactacgcaacgaccggtggtaatttcgattacgtcaaggttaatggtaaccaaattgagttttctggctggcacgcgacgaatcagagcaatgataagaacagccaatggattatcgtcttggttaacggtaaagaggtcaaacgccagctggtcaatgacacgaaagacggcgcagccggcttcaatcgtaatgatgtgtataaagtgaacccagcgatcgaaaatagcattatgtctggcttccagggcattatcacgttgccggttacggtgaaagacgaaaacgtgcagctggtgcaccgcttctccaatgacgcaaaaacgggtgagggcaattatgtcgatttctggagcgaggtgatgtctgtgaaggactctttccaaaagggtaatggtccgctgaaccagtttggcctgcaaaccatcaacggccaacaatactatattgacccgacgaccggccagccgcgtaagaatttcctgctgcaaaacggcaacgattggatttacttcgacaaagacactggcgcaggcaccaacgcgctgaaattgcagtttgataagggcacgattagcgctgacgaacaataccgtcgcggcaacgaggcgtactcctacgatgataagagcattgaaaatgtcaacggttacttgacggcggacacgtggtaccgcccgaagcagatcctgaaggatggcaccacttggaccgattccaaagaaaccgatatgcgtccgatcttgatggtctggtggccaaacacggtgactcaggcgtactatctgaactacatgaaacaatatggcaatctgctgccggcgagcctgccgagctttagcaccgacgccgatagcgcggagttgaatcattattccgagctggtccaacagaatatcgagaaacgtattagcgagactggtagcactgattggctgcgtaccctgatgcacgagttcgtgacgaagaatagcatgtggaacaaagatagcgagaacgttgactacggtggcctgcaactgcaaggtggtttcctgaagtacgttaacagcgacctgacgaagtacgcaaactctgattggcgtctgatgaaccgtaccgcgacgaacattgacggtaagaattacggtggtgccgagtttctgctggcgaatgacatcgacaactctaacccggtggtgcaggccgaagaattgaattggctgtattatctgatgaacttcggtaccatcaccggtaacaacccagaagctaacttcgacggcatccgtgtcgacgcggtcgataatgtggatgttgatctgctgagcattgcccgtgactactttaatgcagcgtataacatggaacaaagcgatgctagcgcgaataagcacatcaatattctggaagattggggctgggacgatccggcgtacgtgaacaaaatcggcaatccacagttgaccatggatgaccgcctgcgtaatgcaattatggacaccctgagcggtgcgccggataagaaccaagcgctgaacaagctgattactcagtctctggtgaatcgcgcaaatgataatactgaaaacgcggtgatcccttcctacaactttgtccgcgctcatgacagcaatgcccaggaccagatccgtcaagcgatccaggcggcaaccggcaaaccttatggcgagttcaacttggatgatgagaaaaagggtatggaggcttacatcaatgaccaaaatagcaccaataagaaatggaacctgtacaacatgccgagcgcatataccatcctgctgacgaataaggactcggtcccgcgtgtctactatggcgacttgtaccaggatggtggccagtacatggaacacaaaactcgttactttgacaccatcacgaatctgctgaaaacccgcgtcaagtatgtcgcaggcggccagaccatgtctgtggataagaatggcattttgactaatgtccgtttcggtaagggtgcgatgaacgcaactgacacgggtaccgatgaaacccgcaccgaaggtatcggcgttgttatcagcaacaatacgaatttgaaactgaatgacggcgaaagcgttgtgctgcacatgggcgctgcccataagaatcagaagtatcgtgcagtgatcctgaccacggaggacggtgtgaagaattacaccaacgacaccgatgcgccggtcgcatacaccgacgcgaacggcgatttgcatttcaccaatactaacctggacggtcagcaatataccgccgttcgtggctacgcaaacccggacgttacgggttatctggccgtctgggttcctgctggtgccgccgatgaccaagacgcacgtaccgctccgagcgacgaggcccacaccacgaaaacggcgtatcgttccaatgcggcattggactccaacgtcatctacgaaggcttttcgaactttatctattggccgacgaccgagagcgagcgcacgaatgtccgcatcgcgcagaacgcggatctgttcaaatcgtggggtatcaccaccttcgagctggcgccacagtacaatagcagcaaggacggtacgtttctggattcgatcattgacaatggttacgcgtttaccgatcgttatgacctgggtatgtctaccccgaacaagtacggtagcgatgaggatctgcgtaacgccctgcaagcactgcacaaggccggtctgcaagccatcgcagattgggttccggaccaaatctacaatctgccgggcaaagaggctgtcacggttactcgtagcgatgaccacggcactacctgggaggttagcccgatcaagaatgtggtgtatatcactaataccatcggtggtggcgaataccagaaaaagtatggtggtgaatttctggacaccttgcaaaaagaatatccgcagctgtttagccaagtttacccggtgacccaaacgacgattgaccctagcgttaagattaaagagtggtccgcgaagtacttcaatggtactaatatcctgcatcgcggtgcgggttacgtcctgcgtagcaatgatggtaagtattacaacctgggtactagcacccagcagttcctgccgagccagctgagcgttcaagataatgagggttacggtttcgttaaagagggtaacaactatcactattatgacgagaacaaacaaatggttaaggacgcgtttatccaggatagcgtcggcaattggtactattttgataagaacggcaatatggttgcaaaccaaagcccggttgaaatcagcagcaacggtgcgagcggcacctacttgtttttgaataatggtaccagcttccgcagcggcctggtcaaaacggatgcaggcacctattactacgatggtgacggtcgcatggttcgtaatcaaacggtttctgacggtgccatgacgtacgttctggacgaaaatggtaaactggtcagcgaatcttttgatagcagcgcgaccgaggcccatccgctgaaaccgggcgatctgaacggtcaaaagtaa

SEQ ID NO: 58 - protein, 1735 aa, Lactobacillus reuteri
MDQQVQSSTTQEQTSTVNADTTKTVNLDTNTDQPAQTTDKNQVANDTTTNQSKTDSTSTTVKNPTFIPVSTLSSSDNEKQSQNYNKPDNGNYGNVDAAYFNNNQLHISGWHATNASQGTDSRQVIVRDITTKTELGRTNVTNNVLRPDVKNVHNVYNADNSGFDVNINIDFSKMKDYRDSIEIVSRYSGNGKSVDWWSQPITFDKNNYAYLDTFEVKNGELHATGWNATNKAINYNHHFVILFDRTNGKEVTRQEVRDGQSRPDVAKVYPQVVGANNSGFDVTFNIGDLDYTHQYQILSRYSNADNGEGDYVTYWFAPQSIAPANQSNQGYLDSFDISKNGEVTVTGWNATDLSELQTNHYVILFDQTAGQQVASAKVDLISRPDVAKAYPTVKTAETSGFKVTFKVSNLQPGHQYSVVSRFSADENGNGNDKRHTDYWYSPVTLNQTASNIDTITMTSNGLHITGWMASDNSINEATPYAIILNNGREVTRQKLTLIARPDVAAVYPSLYNSAVSGFDTTIKLTNAQYQALNGQLQVLLRFSKAVDGNPNGTNTVTDQFSKNYATTGGNFDYVKVNGNQIEFSGWHATNQSNDKNSQWIIVLVNGKEVKRQLVNDTKDGAAGFNRNDVYKVNPAIENSIMSGFQGIITLPVTVKDENVQLVHRFSNDAKTGEGNYVDFWSEVMSVKDSFQKGNGPLNQFGLQTINGQQYYIDPTTGQPRKNFLLQNGNDWIYFDKDTGAGTNALKLQFDKGTISADEQYRRGNEAYSYDDKSIENVNGYLTADTWYRPKQILKDGTTWTDSKETDMRPILMVWWPNTVTQAYYLNYMKQYGNLLPASLPSFSTDADSAELNHYSELVQQNIEKRISETGSTDWLRTLMHEFVTKNSMWNKDSENVDYGGLQLQGGFLKYVNSDLTKYANSDWRLMNRTATNIDGKNYGGAEFLLANDIDNSNPVVQAEELNWLYYLMNFGTITGNNPEANFDGIRVDAVDNVDVDLLSIARDYFNAAYNMEQSDASANKHINILEDWGWDDPAYVNKIGNPQLTMDDRLRNAIMDTLSGAPDKNQALNKLITQSLVNRANDNTENAVIPSYNFVRAHDSNAQDQIRQAIQAATGKPYGEFNLDDEKKGMEAYINDQNSTNKKWNLYNMPSAYTILLTNKDSVPRVYYGDLYQDGGQYMEHKTRYFDTITNLLKTRVKYVAGGQTMSVDKNGILTNVRFGKGAMNATDTGTDETRTEGIGVVISNNTNLKLNDGESVVLHMGAAHKNQKYRAVILTTEDGVKNYTNDTDAPVAYTDANGDLHFTNTNLDGQQYTAVRGYANPDVTGYLAVWVPAGAADDQDARTAPSDEAHTTKTAYRSNAALDSNVIYEGFSNFIYWPTTESERTNVRIAQNADLFKSWGITTFELAPQYNSSKDGTFLDSIIDNGYAFTDRYDLGMSTPNKYGSDEDLRNALQALHKAGLQAIADWVPDQIYNLPGKEAVTVTRSDDHGTTWEVSPIKNVVYITNTIGGGEYQKKYGGEFLDTLQKEYPQLFSQVYPVTQTTIDPSVKIKEWSAKYFNGTNILHRGAGYVLRSNDGKYYNLGTSTQQFLPSQLSVQDNEGYGFVKEGNNYHYYDENKQMVKDAFIQDSVGNWYYFDKNGNMVANQSPVEISSNGASGTYLFLNNGTSFRSGLVKTDAGTYYYDGDGRMVRNQTVSDGAMTYVLDENGKLVSESFDSSATEAHPLKPGDLNGQK

SEQ ID NO: 59 - protein, 1242 aa, Unknown
  unknown Streptococcus sp. C150
MINGKEYYVEDDGTVRKNYVLERNGGSQYFNAETGELSNQKDYRFDKNGGTGSAADSTTNTNVTVNGDKNAFYGTTEKDIELVDGYFTANTWYRPKEILKDGKEWTASTENDKRPLLTVWWPSKAIQASYLNYMREEGLGTNQTFTSYSSQTQMDQAALEVQKRIEERIAREGNTDWLRTTIKNFVKTQPGWNSTSENLDNSDHLQGGALLYNNSNRTSYANSDYRLLNRTPTQQDGTRRYFKDNSSGGFEFLLANDIDNSNPAVQAEQLNWLHYIMNIGSLTGGSEDENFDGVRVDAVDNVNADLLQIASDYFKAKYGVEKSEEEAIKHLSILEAWSHNDAYYNEDTKGAQLPMDDPLRLAMVFSFLRPIGNRSGLEPLITNSLNDRSESKKNTKRMANYTFVRAHDSEVQSVIGQIIKNEINPQSTGNTFTLDEMKKAFKIYNADMRSANKRYTQYNIPSAYAFMLTNKDTVPRVYYGDLYTDDGQYMAQKSPYHDAISTLLQARIRYAAGGQDMKMSYVGSGNTNGWDASGVLTSVRYGKGANNASDAGTAETRNQGMAVILSNQPALRLNSNLTINMGAAHRNQAYRPLLLTTSNGVASYLNDGDANGIVKYTDANGYLTFNPGEISGVRNAQVDGYLAVWVPLGASENQDVRVAASKSKNSSGLVYDSSAALDSQVIYEGFSNFQDFVQDPSQYTNKKIAENANLFKSWGITSFEFAPQYVSSDDGTFLDSVIQNGYAFSDRYDIGMSKDNKYGSLADLKAALKSLHAVGISAIADWVPDQIYNLPGDEVVTATRVNNYGETKDGAIIDHSLYVAKTRTFGNDYQGKYGGAYLDELKRLYPQFFDRVQISTGKRLTTDEKITKWSAKYMNGTNILDRGSEYVLKNGLSGYYGTNGGKVSLPKVVGSNQSTNNNNQNGDGSGRFEKSWGSVYYRYNDGQRARNAFIKDNDGNVYYFDNTGRMAIGEKTIDGKQYFFLANGVQLRDGYRQNRRGQVFYYDENGIMSQTGKPSPKPEPKPDNNTFSRNQFIQIGNNVWAYYDGNGKRVIGRQNINGQELFFDNNGVQVKGRTAQVDGVTRYFDANSGEMARNRFAEVEPGVWAYFNNDGAAVTGSQNINGQTLYFDQNGHQVKGALVTVDGNLRYYDANSGDLYRNRFQEVNGSWYYFDGNGNAVKGMVNINGQNLLFDNDGKQVKGHLVRVNGVIRYYDPNSGEMAVNRWVEISSGWWVYFDGEGRGQI

SEQ ID NO: 60 - protein, 1518 aa, Streptococcus salivarius
MENKIHYKLHKVKKQWVTIAVASVALATVLGGLSVTTSSVSADETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 61 - protein, 1528 aa, Streptococcus salivarius K12
MTNKITGKIIMENKVHYKLHKVKKQWVTIAVASAALATVVGGLSATTSSVSADETQDKIVTQPNLDTTADLVTSTEATKEVDKRTNTKEADVLTPAKETNAVETATTTNTQATAEAATTATTSDVAVAAVPNKEAVVTTDAPAVTTEKAEEQPATVKAEVVNTEVKAPQAALKDSEVEAALSLKNIKYTDGKYYYVNEDGSHKENFAITVNGQLLYFGKDGALTSSSTHSFTPGTTNIVDGFSINNRAYDSSEASFELINGYLTADSWYRPVSIIKDGVTWQASTAEDFRPLLMAWWPNVDTQVNYLNYMSKVFNLEAKYTSTDKQADLNRAAKDIQVKIEQKIQAEKSTQWLRETISAFVKTQPQWNKETENYSKGGGEDHLQGGALLYVNDSRTPWANSNYRLLNRTATNQTGTINKSVLDEQSDPNHMGGFDFLLANDVDLSNPVVQAEQLNQIHYLMNWGSIVMGDKDANFDGIRVDAVDNVNADMLQLYTNYFREYYGVNKSEAQALAHISVLEAWSLNDNHYNDKTDGAALAMENKQRLALLFSLAKPIKDRTPAVSPLYNNTFNTTQRDFKTDWINKDGSTAYNEDGTAKQSTIGKYNEKYGDASGNYVFIRAHDNNVQDIIAEIIKKEINKKSDGFTISDSEMKQAFEIYNKDMLSSNKKYTLNNIPAAYAVMLQNMETITRVYYGDLYTDDGHYMETKSPYHDTIVNLMKNRIKYVSGGQAQRSYWLPTDGKMDNSDVELYRTSEVYTSVRYGKDIMTADDTEGSKYSRTSGQVTLVVNNPKLTLHESAKLNVEMGKIHANQKYRALIVGTADGIKNFTSDAEAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGRDYQAQYGGEFLAELKAKYPKMFTENMISTGKPIDDSVKLKQWKAKYFNGTNVLDRGVGYVLSDEATGKYFTVTKEGNFIPLQLTGNEKAVTGFSNDGKGITYFGTSGNQAKSAFVTFNGNTYYFDARGHMVTNGEYSPNGKDVYRFLPNGIMLSNAFYVDANGNTYLYNYKGQMYKGGYTKFDVTETDKDGNESKVVKFRYFTNEGVMAKGLTVIDGSTQYFGEDGFQTKDKLATYKGKTYYFEAHTGNAIKNTWRNIDGKWYHFDENGVAATGAQVINGQKLYFNEDGSQVKGGVVKNADGTYSKYKEGSGELVTNEFFTTDGNVWYYAGADGKTVTGAQVINGQHLYFKEDGSQVKGGVVKNADGTYSKYDAATGERLTNEFFTTGDNNWYYIGSNGKTVTGEVKIGADTYYFAKDGKQVKGQTVTAGNGRISYYYGDSGKKAISTWIEIQPGIYVYFDKTGIAYPPRVLN

SEQ ID NO: 62 - protein, 1518 aa, Streptococcus salivarius SK126
MENKIHYKLHKVKKQWVTIAVASVALATVLGGLSVTTSSVSADETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLTLDQSAKLNVEMGKIHANQKYRALIVGTADGIKNFTSDADAIAAGYVKETDSNGVLTFGANDIKGYETFDMSGFVAVWVPVGASDDQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANTKSSGKDYQAKYGGEFLAELKAKYPEMFKVNMISTGKPIDDSVKLKQWKAEYFNGTNVLERGVGYVLSDEATGKYFTVTKDGNFIPLQLTGNEKVVTGFSNDGKGITYFGTSGTQAKSAFVTFNGNTYYFDARGHMVTNGEYSPNGKDVYRFLPNGIMLSNAFYVDANGNTYLYNSKGQMYKGGYTKFDVTETDKDGKESKVVKFRYFTNEGVMAKGVTVIDGFTQYFGEDGFQAKDKLVTFKGKTYYFDAHTGNAIKDTWRNINGKWYHFDANGVAATGAQVINGQKLYFNEDGSQVKGGVVKNADGTYSKYKEGSGELVTNEFFTTDGNVWYYAGANGKTVTGAQVINGQHLYFNADGSQVKGGVVKNADGTYSKYDASTGERLTNEFFTTGDNNWYYIGANGKSVTGEVKIGDDTYFFAKDGKQVKGQTVSAGNGRISYYYGDSGKRAVSTWIEIQPGVYVYFDKNGIAYPPRVLN

SEQ ID NO: 63 - protein, 1431 aa, Streptococcus salivarius PS4
MTKETNTVDAATTTNTQAAADAATKTADAAVTALPNKEAVVTTDAPAVTTEKAAEQPATVKSEVVNTEVKAPEAALKDSEVEAALSLKNIKNIDGKYYYVNKDGSHKENFAITVNGQLLYFGKDGALTSSSTYSFTQGTTNIVDGFSKNNRAYDSSEASFELIDGYLTADSWYRPVSIIKDGVTWQASTKEDFRPLLMAWWPNVDTQVNYLNYMSKVFNLDAKYTSTDKQVDLNRAAKDIQVKIEQKIQAEKSTQWLREAISAFVKTQPQWNKETENFSKGGGEDHLQGGALLYVNDPRTPWANSNYRLLNRTATNQTGTIDKSVLDEQSDPNHMGGFDFLLANDVDTSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKKAFEIYNKDMLSSDKKYTLNNIPAAYAVMLQNMETITRVYYGDLYTDDGHYMETKSPYYDTIVNLMKNRIKYVSGGQAQRSYWLPTDGKMDKSDVELYRTNEVYTSVRYGKDIMTADDTQGSKYSRTSGQVTLVVNNPKLSLDKSAKLDVEMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNEKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGGVVKNADGTFSKYKDGSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 64 - protein, 1532 aa, Unknown
  unknown Streptococcus sp. C150
MENKVHYKLHKVKKQWVTIAVASAALATVVGGLSATTSSVSADETQDKTVTQPNSDTTADLVTSTEATKEVDKRTNTKEADVLTPAKETNTVETAATTNTQATAEAAKTATTTNTQATAEVAKTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTQGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSNYRLLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDVAALAMENKQRLALLFSLAKPIKERTPAVSPLYNNTFNTTQRDEKTDWINKDGSKAYNEDGTVKKSTIGKYNEKYGDASGNYVFIRAHDNNVQDIIAEIIKKEINEKSDGFTITDSEMKRAFEIYNKDMLSNDKKYTLNNIPAAYAVMLQNMETITRVYYGDLYTDDGNYMEAKSPYYDTIVNLMKSRIKYVSGGQAQRSYWLPTDGKMDKSDVELYRTNEVYTSVRYGKDIMTADDTQGSKYSRTSGQVTLVVNNPKLTLDQSAKLNVVMGKIHANQKYRALIVGTPNGIKNFTSDAEAIAAGYVKETDGNGVLTFGANDIKGYETFDMSGFVAVWVPVGASDDQDIRVAASTAAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRNALKALHKAGIQAIADWVPDQIYQLPGKEVVTATRTDGAGRKISDAIIDHSLYVANSKSSGKDYQAKYGGEFLAELKAKYPEMFKVNMISTGKPIDDSVKLKQWKAEYFNGTNVLDRGVGYVLSDEATGKYFTVTKEGNFIPLQLKGNKKVITGFSSDGKGITYFGTSGNQAKSAFVTFNGNTYYFDARGHMVTNGEYSPNGKDVYRFLPNGIMLSNAFYVDGNGNTYLYNSKGQMYKGGYSKFDVTETKDGKESKVVKFRYFTNEGVMAKGVTVVDGFTQYFNEDGIQSKDELVTYNGKTYYFEAHTGNAIKNTWRNIKGKWYHFDANGVAATGAQVINGQHLYFNEDGSQVKGSIVKNADGTFSKYKDSSGDLVVNEFFTTGDNVWYYAGANGKTVTGAQVINGQHLFFKEDGSQVKGDFVKNSDGTYSKYDAASGERLTNEFFTTGDNHWYYIGANGKTVTGEVKIGDDTYFFAKDGKQLKGQIVTTRSGRISYYFGDSGKKAISTWVEIQPGVFVFFDKNGLAYPPENMN

SEQ ID NO: 65 - protein, 1341 aa, Streptococcus salivarius
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 66 - protein, 844 aa, Streptococcus mutans
SFAQYNQVYSTDAANFEHVDHYLTAESWYRPKYILKDGKTWTQSTEKDFRPLLMTWWPDQETQRQYVNYMNAQLGIHQTYNTATSPLQLNLAAQTIQTKIEEKITAEKNTNWLRQTISAFVKTQSAWNSDSEKPFDDHLQKGALLYSNNSKLTSQANSNYRILNRTPTNQTGKKDPRYTADRTIGGYEFLLANDVDNSNPVVQAEQLNWLHFLMNFGNIYANDPDANFDSIRVDAVDNVDADLLQIAGDYLKAAKGIHKNDKAANDHLSILEAWSYNDTPYLHDDGDNMINMDNRLRLSLLYSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRITRTSGVVVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFSLVSDNTFLPKSLVNP

SEQ ID NO: 67 - protein, 1039 aa, Lactobacillus reuteri [sequence omitted]

SEQ ID NO: 68 - protein, 12 aa, Unknown
  Catalytic active site motif FDxxRxDAxDNV
  MISC_FEATURE (3)..(4): Xaa is any amino acid
  MISC_FEATURE (6)..(6): Xaa is any amino acid
  MISC_FEATURE (9)..(9): Xaa is any amino acid
FDXXRXDAXDNV

SEQ ID NO: 69 - protein, 10 aa, Unknown
  Catalytic active site motif ExWxxxDxxY
  MISC_FEATURE (2)..(2): Xaa is any amino acid
  MISC_FEATURE (4)..(6): Xaa is any amino acid
  MISC_FEATURE (8)..(9): Xaa is any amino acid
EXWXXXDXXY

SEQ ID NO: 70 - protein, 6 aa, Unknown
  Catalytic active site motif FxRAHD
  MISC_FEATURE (2)..(2): Xaa is any amino acid
FXRAHD

SEQ ID NO: 71 - protein, 7 aa, Unknown
  Catalytic active site motif IxNGYAF
  MISC_FEATURE (2)..(2): Xaa is any amino acid
IXNGYAF

SEQ ID NO: 72 - protein, 7 aa, Unknown
  Motif SxxRxxN upstream of Motifs 1a and 1b
  MISC_FEATURE (2)..(3): Xaa is any amino acid
  MISC_FEATURE (5)..(6): Xaa is any amino acid
SXXRXXN

SEQ ID NO: 73 - protein, 24 aa, Unknown
  Motif GGxxxLLxNDxDxSNPxVQAExLN downstream of Motifs 1a and 1b
  MISC_FEATURE (3)..(5): Xaa is any amino acid
  MISC_FEATURE (8)..(8): Xaa is any amino acid
  MISC_FEATURE (11)..(11): Xaa is any amino acid
  MISC_FEATURE (13)..(13): Xaa is any amino acid
  MISC_FEATURE (17)..(17): Xaa is any amino acid
  MISC_FEATURE (22)..(22): Xaa is any amino acid
GGXXXLLXNDXDXSNPXVQAEXLN

SEQ ID NO: 74 - protein, 8 aa, Unknown
  Motif WxxxDxxY upstream of Motif 2
  MISC_FEATURE (2)..(4): Xaa is any amino aicd
  MISC_FEATURE (6)..(7): Xaa is any amino aicd
WXXXDXXY

SEQ ID NO: 75 - protein, 8 aa, Unknown
  Motif YxFxRAHD downstream of Motif 2
  MISC_FEATURE (2)..(2): Xaa is any amino acid
  MISC_FEATURE (4)..(4): Xaa is any amino acid
YXFXRAHD

SEQ ID NO: 76 - protein, 6 aa, Unknown
  Motif YxxGGQ upstream of Motifs 3a and 3b
  MISC_FEATURE (2)..(3): Xaa is any amino acid
YXXGGQ

SEQ ID NO: 77 - protein, 4 aa, Unknown
  Motif VRxG downstream of Motifs 3a and 3b
  MISC_FEATURE (3)..(3): Xaa is any amino acid
VRXG

SEQ ID NO: 78 - protein, 13 aa, Unknown
  Motif 1a
  MISC_FEATURE (1)..(1): Xaa can be Asp(D) or Asn(N)
  MISC_FEATURE (4)..(4): Xaa can be Ile(I) or Val(V)
XKSXLDEQSDPNH

SEQ ID NO: 79 - protein, 30 aa, Unknown
  Motif 2
  MISC_FEATURE (6)..(6): Xaa is Lys(K) or Thr(T)
  MISC_FEATURE (14)..(14): Xaa is Val(V) or Ala(A)
  MISC_FEATURE (16)..(16): Xaa is Gln(Q) or Lys(K)
NKDGSXAYNEDGTXKXSTIGKYNEKYGDAS

SEQ ID NO: 80 - protein, 19 aa, Unknown
  Motif 3a
  MISC_FEATURE (9)..(9): Xaa is Asn(N) or Lys(K)
  MISC_FEATURE (18)..(18): Xaa is Asn(N) or Ser(S)
LPTDGKMDXSDVELYRTXE

SEQ ID NO: 81 - protein, 11 aa, Unknown
  Motif 1b
  MISC_FEATURE (2)..(2): Xaa is Ser(S) or Pro(P)
  MISC_FEATURE (6)..(6): Xaa is Tyr(Y) or Phe(F)
  MISC_FEATURE (8)..(8): Xaa is Ala(A), Gln(Q), or Pro(P)
DXRFTXNXNDP

SEQ ID NO: 82 - protein, 5 aa, Unknown
  Motif 3b
IGNGE

SEQ ID NO: 83 - protein, 1466 aa, Streptococcus dentirousetti
MEKNVHYKMHKVKKRWVTISVASATMLASALGASVANADTDAAAADANNAANAAVAEDQAASSQDNQAAPLPATATSEDTGSTEEVAVNQDAQVANTDTQEAKWVPNTGNNSEISDAATPQAAVAATDAQSVPQALTNLSNVKQVDGKYYYYDADGNVKKNFAVSVGDAIFYFDETGAYKDTSKVDADKTSSSVNQTTETFAANNRAYSTAAENFEAIDNYLTADSWYRPKSILKDGTTWTESTKDDFRPLLMAWWPDTETKRNYVNYMNKVVGIDKTYTAETSQADLTAAAELVQARIEQKITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLNDDGDNLMNMDNKFRLSMLWSLAKPTNVRSGLNPLIHNSVVDREVDDREVEATPNYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYDAIESLLKARMKYVSGGQAMQNYNIGNGEILTSVRYGKGALKQSDKGDKTTRTSGIGVVMGNQSNFSLEGKVVALNMGATHTKQKYRALMVSTETGVAIYNSDEEAEAAGLIKTTDENGYLYFLNDDLKGVANPQVSGFLQVWVPVGAPADQDIRVAATDAASTDGKSLHQDAALDSRVMFEGFSNFQSFATKEEEYTNVVIAKNVDKFVSWGITDFEMAPQYVSSTDGTFLDSVIQNGYAFTDRYDLGMSKANKYGTADQLVAAIKALHAKGLRVMADWVPDQMYTFPKKEVVTVTRTDKFGNPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPAAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGLTRVAGHDQYFDKDGIQAKNKIIVTRDGKVRYFDEHNGNAATNTFISDQAGHWYYLGKDGVAVTGAQTVGKQHLYFEANGQQVKGDFVTAKDGKLYFLDGDSGDMWTDTFVQDKAGHWFYLGKDGAAVTGAQTVRGQKLYFKANGQQVKGDIVKGADGKIRYYDANSGDQVYNRTVKGSDGKTYIIGNDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 84 - DNA, 3978 bp, Artificial sequence
  7527-NT-dIS1a, GTF lacking Motif 1a
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattaacaaagacggctcgaaggcgtacaatgaagatggtacggtgaaacaaagcaccatcggtaagtacaacgagaaatatggcgacgcaagcggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtagctattggctgccgactgacggtaagatggacaattcggatgtggaactgtaccgtaccaatgaagtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaattag

SEQ ID NO: 85 - protein, 1325 aa, Artificial sequence
  7527-NT-dIS1a, GTF lacking Motif 1a
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 86 - DNA, 3933 bp, Artificial sequence
  7527-NT-dIS2, GTF lacking Motif 2
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtacgattgacaagagcatcctggatgagcagtccgacccgaaccacatgggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtagctattggctgccgactgacggtaagatggacaattcggatgtggaactgtaccgtaccaatgaagtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaat

SEQ ID NO: 87 - protein, 1311 aa, Artificial sequence
  7527-NT-dIS2, GTF lacking Motif 2
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWIGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 88 - DNA, 3960 bp, Artificial sequence
  7527-NT-dIS3a, GTF lacking Motif 3a
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtacgattgacaagagcatcctggatgagcagtccgacccgaaccacatgggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattaacaaagacggctcgaaggcgtacaatgaagatggtacggtgaaacaaagcaccatcggtaagtacaacgagaaatatggcgacgcaagcggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtgtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaattag

SEQ ID NO: 89 - protein, 1319 aa, Artificial sequence
  7527-NT-dIS3a, GTF lacking Motif 3a
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 90 - DNA, 3888 bp, Artificial sequence
  7527-NT-dIS1a,2, GTF lacking Motifs 1a and 2
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtagctattggctgccgactgacggtaagatggacaattcggatgtggaactgtaccgtaccaatgaagtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaattag

SEQ ID NO: 91 - protein, 1295 aa, Artificial sequence
  7527-NT-dIS1a,2, GTF lacking Motifs 1a and 2
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWIGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 92 - DNA, 3912 bp, Artificial sequence
  7527-NT-dIS1a,3a, GTF lacking Motifs 1a and 3a
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattaacaaagacggctcgaaggcgtacaatgaagatggtacggtgaaacaaagcaccatcggtaagtacaacgagaaatatggcgacgcaagcggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtgtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaattag

SEQ ID NO: 93 - protein, 1303 aa, Artificial sequence
  7527-NT-dIS1a,3a, GTF lacking Motifs 1a and 3a
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 94 - DNA, 3870 bp, Artificial sequence
  7527-NT-dIS2,3a, GTF lacking Motifs 2 and 3a
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtacgattgacaagagcatcctggatgagcagtccgacccgaaccacatgggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtgtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaattag

SEQ ID NO: 95 - protein, 1289 aa, Artificial sequence
  7527-NT-dIS2,3a, GTF lacking Motifs 2 and 3a
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWIGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 96 - DNA, 3822 bp, Artificial sequence
  7527-NT-dIS1a,2,3a, GTF lacking Motifs 1a, 2 and 3a
atgatcgacggtaaatactattacgttaatgaagatggcagccataaggaaaacttcgctattaccgtgaacggccagttactgtattttggcaaagatggcgcactgacgtccagctccacgtatagctttaccccaggcaccaccaatatcgtggatggtttttctattaacaaccgcgcgtacgatagcagcgaggcgtccttcgagctgattgacggttatctgaccgcggattcgtggtaccgtccggcgagcatcattaaagacggtgtgacctggcaggccagcacggcagaggacttccgtccgctgctgatggcctggtggccgaacgtggatacccaggtgaattacctgaactacatgtctaaagttttcaacttggatgcaaagtacagctcaaccgataaacaagaaaccctgaaggttgccgcaaaagacattcagattaagattgagcagaaaatccaggccgaaaagtctacccaatggctgcgtgagactatcagcgcttttgtgaaaacccaaccgcaatggaacaaggaaaccgaaaactacagcaagggtggcggtgaggatcatttgcagggcggtgcactgctgtatgttaatgatagccgcaccccgtgggcgaatagcgactatcgtcgcctgaaccgcaccgcaacgaaccagaccggtggtggtttcgactttctgctggcaaatgatgtcgatctgagcaatccggtggtgcaagcagagcagctgaaccagatccactacttgatgaactggggttctattgtcatgggtgacaaagatgcgaattttgacggcattcgtgttgatgcggtcgataacgtcgacgcggacatgttgcaactgtataccaactatttccgtgagtactacggcgttaataaaagcgaggctaacgctctggcgcatattagcgttcttgaggcgtggagcctgaacgacaatcactataacgacaagaccgacggtgccgcgttggcaatggagaacaaacaacgcctggccctgctgttcagcctggcgaaaccgatcaaagagcgtacgccggcagttagcccgctgtataacaataccttcaacacgactcagcgtgacgaaaagaccgattggattggtaactatgtttttattcgtgcgcacgacaacaatgtccaagacatcatcgcggagatcattaagaaagaaatcaacccgaaatccgacggtttcacgattaccgatgcagaaatgaagcaagccttcgaaatctacaacaaagatatgctgtccagcgacaaaaagtacacgctgaataacattcctgcggcttacgcggtgatgcttcaaaacatggaaacgatcacgcgtgtgtattacggtgatttgtataccgacgacggtcactatatggaaaccaagagcccatactatgataccattgtcaatctgatgaaatcccgtatcaaatatgtttctggtggccaggcgcagcgtgtttataccagcgtacgttacggtaaagatatcatgacggcgaacgataccgagggcagcaagtatagccgtacctccggccaagttaccctggtcgcaaataacccgaagctgaatctggatcagagcgctaagctgaatgttgagatgggtaaaatccacgcgaaccagaagtatcgcgcattgattgtcggtaccgcggatggtatcaagaatttcaccagcgatgcggacgcgattgcagccggttacgttaaagagactgacagcaatggtgtgctgacgtttggtgccaatgacattaagggctacgaaaccttcgacatgagcggttttgttgcggtttgggtgccggtcggtgcctccgataatcaggacattcgcgttgctccgagcaccgaggcgaaaaaggaaggcgagctgaccttgaaagctaccgaggcatacgattcgcaactgatctacgagggtttttccaattttcagacgattcctgacggtagcgacccgagcgtttacacgaatcgcaaaatcgctgaaaatgtcgacctgttcaagagctggggcgtgaccagcttcgaaatggctccgcaattcgtgtctgcggacgacggcacctttctggatagcgtgattcaaaacggttacgcgttcgcagaccgttatgacctggcgatgagcaagaacaataagtatggcagcaaagaagatctgcgtgatgcgctgaaggctctgcataaggccggtattcaggcaatcgcggactgggttccggaccagatctaccaactgccaggtaaagaagtggtcaccgcaactcgcacggacggtgcgggtcgtaagattgccgatgcgattattgaccactctctgtatgttgcgaatagcaagtccagcggcaaagactaccaggcgaaatatggtggcgagttcctggcggaactgaaagcgaagtatccggagatgtttaaggtgaatatgattagcacgggtaagccgattgacgatagcgttaagctgaagcagtggaaggcagagtatttcaatggcactaacgtgctggagcgtggtgttggctatgtcttgtccgacgaagcgaccggcaagtatttcaccgttaccaaagaaggcaacttcatcccgctgcaactgactggcaaggaaaaggttatcacgggttttagcagcgacggtaagggcatcacctattttggtacgagcggtacgcaggccaagagcgcgtttgttacgtttaatggtaatacgtactactttgatgcgcgtggccacatggttaccaattccgagtattcaccgaatggtaaagatgtgtaccgttttctgcctaacggcatcatgttgagcaacgctttttacatcgatgcaaacggcaacacgtacttgtataacagcaaaggtcaaatgtataaaggtggctacaccaaattcgacgtgagcgagactgataaagacggcaaagaaagcaaagttgtgaagtttcgttacttcaccaatgagggtgtcatggcgaaaggtgtcaccgtgattgatggtttcacccaatactttggcgaagatggcttccaggcaaaagataagctcgtcacgtttaagggcaaaacctactatttcgacgcgcataccggtaatggcatcaaggacacctggcgcaacattaacggcaaatggtactacttcgatgccaatggcgtggcagccacgggtgcacaagttattaacggtcaaaaactgtacttcaatgaggatggtagccaggtcaagggcggtgtggtgaaaaacgccgacggtacctactccaaatacaaagagggttttggcgaactggtcactaatgagtttttcacgacggacggtaatgtgtggtactatgcaggcgctaatggtaagaccgttacgggcgcacaggtcatcaacggccagcacctgtactttaatgccgatggctctcaagttaagggtggcgtcgtcaaaaatgctgatggtacgtatagcaagtacaatgcgagcaccggtgagcgtctgaccaacgagttcttcaccacgggcgacaataactggtactacatcggtgcgaacggtaagagcgtcacgggtgaggtgaagattggtgacgatacgtatttcttcgcgaaagacggtaaacaagtcaaaggtcagaccgtcagcgccggtaacggccgcatctcttactactatggtgactcgggcaaacgtgcagtgagcacctggatcgagattcagccgggtgtgtacgtttacttcgacaaaaacggcctggcgtatccgccacgtgtcctgaattag

SEQ ID NO: 97 - protein, 1273 aa, Artificial sequence
  7527-NT-dIS1a,2,3a, GTF lacking Motifs 1a, 2 and 3a
MIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWIGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

What is claimed is:

1. A glucosyltransferase enzyme comprising an amino acid sequence that is at least 97% identical to
    SEQ ID NO:87,
    SEQ ID NO:91,
    SEQ ID NO:95, or
    SEQ ID NO:97,
    wherein said glucosyltransferase enzyme lacks the amino acid sequence of SEQ ID NO:79, and
    wherein said glucosyltransferase enzyme produces a branched alpha-glucan polymer.

2. A reaction solution comprising water, sucrose, and a glucosyltransferase enzyme according to claim 1.

3. A method for producing a branched alpha-glucan polymer comprising:
    (a) contacting at least water, sucrose, and a glucosyltransferase enzyme according to claim 1, whereby branched alpha-glucan polymer is produced, and
    b) optionally, isolating the branched alpha-glucan polymer produced in step (a).

4. The glucosyltransferase of claim 1, wherein the glucosyltransferase comprises an amino acid sequence that is at least 98% identical to SEQ ID NO:87, SEQ ID NO:91, SEQ ID NO:95, or SEQ ID NO:97.

* * * * *